US007799906B1

(12) United States Patent
Rottmann et al.

(10) Patent No.: US 7,799,906 B1
(45) Date of Patent: Sep. 21, 2010

(54) COMPOSITIONS AND METHODS FOR MODULATING LIGNIN OF A PLANT

(75) Inventors: William H. Rottmann, Summerville, SC (US); Marie B. Connett, Canberra (AU); Leonard N. Bloksberg, Auckland (NZ); Richard L. Forster, Auckland (NZ)

(73) Assignee: Arborgen, LLC, Summerville, SC (US)

( * ) Notice: Subject to any disclaimer, the term of this patent is extended or adjusted under 35 U.S.C. 154(b) by 1346 days.

(21) Appl. No.: 10/946,644

(22) Filed: Sep. 22, 2004

(51) Int. Cl.
  *C12N 15/00* (2006.01)
  *C12N 15/09* (2006.01)
  *C12N 15/11* (2006.01)
  *C12N 15/113* (2006.01)
  *C12N 15/29* (2006.01)
  *C07H 21/04* (2006.01)
  *A01H 5/00* (2006.01)

(52) U.S. Cl. .................. 536/23.6; 536/23.1; 536/24.5; 800/278; 800/285; 800/295; 800/298; 435/320.1

(58) Field of Classification Search .................. None
See application file for complete search history.

(56) References Cited

U.S. PATENT DOCUMENTS

| | | | |
|---|---|---|---|
| 4,795,855 A | 1/1989 | Fillatti et al. | |
| 5,491,090 A | 2/1996 | Handley, III et al. | |
| 5,506,136 A | 4/1996 | Becwar et al. | |
| 5,850,020 A | 12/1998 | Bloksberg et al. | |
| 5,856,191 A | 1/1999 | Handley, III | |
| 6,214,164 B1 * | 4/2001 | Rantala ..................... | 162/25 |
| 6,252,135 B1 | 6/2001 | Chiang et al. | |
| 6,380,459 B1 | 4/2002 | Perera et al. | |
| 6,410,718 B1 | 6/2002 | Bloksberg | |
| 6,506,559 B1 | 1/2003 | Fire et al. | |
| 6,518,485 B1 | 2/2003 | Connett-Porceddu et al. | |
| 6,682,931 B2 | 1/2004 | Becwar et al. | |
| 7,402,428 B2 | 7/2008 | Forster et al. | |
| 2002/0100083 A1 | 7/2002 | Connett-Porceddu et al. | |
| 2002/0107644 A1 | 8/2002 | Meglen et al. | |
| 2002/0113212 A1 | 8/2002 | Meglen et al. | |
| 2002/0124281 A1 | 9/2002 | Chiang et al. | |
| 2003/0131373 A1 * | 7/2003 | Bloksberg et al. ........... | 800/278 |
| 2003/0180751 A1 | 9/2003 | Demmer et al. | |
| 2003/0221211 A1 * | 11/2003 | Rottmann et al. ........... | 800/278 |
| 2004/0146904 A1 | 7/2004 | Phillips et al. | |
| 2004/0163146 A1 | 8/2004 | Phillips et al. | |
| 2006/0101535 A1 | 5/2006 | Forster et al. | |
| 2006/0130183 A1 | 6/2006 | Forster et al. | |
| 2009/0077686 A1 | 3/2009 | Forster et al. | |

FOREIGN PATENT DOCUMENTS

| | | |
|---|---|---|
| AU | 756359 | 10/2001 |
| EP | 0271988 B1 | 8/1995 |
| WO | WO 98/36083 | 8/1998 |
| WO | WO 9910498 * | 3/1999 |
| WO | WO 99/24561 | 5/1999 |
| WO | WO 00/12715 A1 | 3/2000 |
| WO | WO 00/22099 | 4/2000 |
| WO | WO 00/53724 A2 | 9/2000 |
| WO | WO 00/58489 | 10/2000 |
| WO | WO 02/20717 A2 | 3/2002 |
| WO | WO 2006/036698 A2 | 4/2006 |

OTHER PUBLICATIONS

Sewalt et al 1997 Plant Physiology 115:41-50, provided by Applicant.*
Tzifira, et al., *Plant Molec. Biol. Reporter*, 1997, vol. 15, pp. 219-235.
International Search Report for International Application No. PCT/US05/33824, dated Dec. 4, 2008. (2 pgs.).
Kajita et al., "Alterations in the Biosynthesis of Lignin in Transgenic Plants with Chimeric Genes for 4-Coumarate: Coenzyme A Ligase," *Plant and Cell Physiology*, vol. 37, No. 7, pp. 957-965 (1996).
Smith et al., "Total Silencing by Intron-spliced Hairpin RNAs," *Nature*, vol. 407, pp. 319-320 (Sep. 21, 2000).
Notice of References cited in the corresponding U.S. Appl. No. 12/185,623, mailed Jul. 17, 2009 (1 pg.).
Wimmer, et al., "Direct Effects of Wood Characteristics on Pulp and Handsheet Properties of *Eucalyptus globulus*", *Holzforschung*, vol. 56, pp. 244-252, 2002.
Garrote, et al., "Hydrothemal and Pulp processing of Eucalyptus", *Bioresource Technology*, vol. 88, pp. 61-68, 2003.
The Supplemental European Search Report of the related EP application No. EP 05 79 9768, dated Dec. 14, 2009.
Fukushima, Kazuhiko, "Regulation of syringyl to guaiacyl ratio in lignin biosynthesis", *Journal of Plant Research*, vol. 114, No. 1116, 2001, pp. 499-508.
Wagner, et al., "Suppression of 4-Coumarate-CoA Ligase in the Coniferous Gymnosperm Pinus radiate", *Plant Physiology*, vol. 149, No. 1, 2009, pp. 370-383.
Colliver, et al., (Plant molecular Biology, 35: pp. 509-522, 1997).
Elomaa, et al., (Molecular Breeding, 2: pp. 41-50, 1996).
Bruening, George, (Proc. Natl. Acad. Sci., 95: pp. 13349-133351, 1998).
The PTO 892 received in the related U.S. Appl. No. 12/068,716, dated Sep. 25, 2009. (2 pgs.).
Anterola et al., "Trends in lignin modification: a comprehensive analysis of the effects of genecit manipulations/mutations on lignification and vascular integrity," Phytochemistry, 2002, pp. 221-294, vol. 61.

(Continued)

*Primary Examiner*—Anne Marie Grunberg
*Assistant Examiner*—Brent Page
(74) *Attorney, Agent, or Firm*—Foley & Lardner LLP

(57) ABSTRACT

Novel plant monolignol synthesis, monolignol transport, and lignin polymerization genes and polypeptides encoded by such genes are provided. These genes and polynucleotide sequences are useful regulating the lignification process and plant phenotype. Moreover, these genes are useful for expression profiling of plant monolignol synthesis, monolignol transport, and lignin polymerization genes. The invention specifically provides polynucleotide and polypeptide sequences isolated from *Eucalyptus* and *Pinus*.

16 Claims, 233 Drawing Sheets

OTHER PUBLICATIONS

Arencibia et al., "An efficient protocol for sugarcane (*Saccharum* spp. L.) transformation mediated by *Agrobacterium tumefaciens*," Transgenic Research, 1998, pp. 213-222, vol. 7.

Arziman et al., "E-RNAi: a web application to design optimized RNAi constructs," Nucleic Acids Research, 2005, pp. W582-W588, vol. 33.

Carthew et al., "Gene silencing by double-stranded RNA," Current Opinion in Cell Biology, 2001, pp. 244-248, vol. 13.

Chang et al., "A Simple and Efficient Method for Isolating RNA from Pine trees," Plant Molecular Biology Reporter, 1993, pp. 113-116, vol. 11, No. 2.

Cheng et al., "*Agrobacterium*-transformed rice plants expressing synthetic *cryIA(b)* and *cryIA(c)* genes are highly toxic to striped stem borer and yellow stem borer," Proc. Natl. Acad. Sci. USA, Mar. 1998, pp. 2767-2772, vol. 95.

Cheng et al., "Genetic Transformation of Wheat Mediated by *Agrobacterium tumefaciens*," Plant Physiol., 1997, pp. 971-980, vol. 115.

Delbreil et al., "*Agrobacterium*-mediated transformation of *Asparagus officinalis* L. long-term embryogenic callus and regeneration of transgenic plants," Plant Cell Reports. 1993, pp. 129-132, vol. 12.

Elbashir et al., "RNA interference is mediated by 21- and 22-nucleotide RNAs," Genes & Development, 2001, pp. 188-200, vol. 15.

Enriquez-Obregón et al., "Herbicide-resistant sugarcane (*Saccharum officinarum* L.) plants by *Agrobacterium*-mediated transformation," Plants, 1998, pp. 20-27, vol. 206.

Fire et al., "Potent and specific genetic interference by double-stranded RNA in *Caenorhabditis elegans*," Nature, 1998, pp. 806-811, vol. 391.

Fukushima et al., "Extraction and Isolation of Lignig for Utilization as a Standard to Determine Lignin Concentration Using the Acetyl Bromide Spectrophotometric Method," Journal of Agricultural and Food Chemistry, Jul. 2001, pp. 3133-3139, vol. 49, No. 7.

Hauffe et al., "Combinatorial interactions between positive and negative cis-acting elements control spatial patterns of *4CL-1* expression in transgenic tobacco," The Plant Journal, 1993, pp. 235-253, vol. 4, No. 2.

Hiei et al., "Transformation of rice mediated by *Agrobacterium tumefaciens*," Plant Molecular Biology, 1997, pp. 205-218, vol. 35.

Ishida et al., "High efficiency transformation of maize (Zea *mays* L.) mediated by *Agrobacterium tumefaciens*," Nature Biotechnology, Jun. 1996, pp. 745-750, vol. 14.

Jefferson et al., "GUS-fusions: β-glucuronidase as a sensitive and versatile gene fusion marker in higher plants," The EMBO Journal, 1987, pp. 3901-3907, vol. 6, No. 13.

Kawaoka et al., "Functional analysis of tobacco LIM protein Ntlin 1 involved in lignin biosynthesis," The Plant Journal, 2000, pp. 289-301, vol. 22, No. 4.

Kawaoka et al., "Transcriptional control of lignin biosynthesis by tobacco LIM protein," Phytochemistry, 2001, pp. 1149-1157, vol. 57.

Leple et al., "Transgenic poplars: expression of chimeric genes using four different contructs," Plant Cell Reports, 1992, pp. 137-141, vol. 11.

Levin et al., "Methods of double-stranded RNA-mediated gene inactivation in *Arabidopsis* and their use to define an essential gene in methionine biosynthesis," Plant Molecular Biology, 2000, pp. 759-775, vol. 44.

Li et al., "A new method for the analysis of phenolic groups in lignins by $^1$H NMR spectrometry," Nordic Pulp and Paper Research Journal, 1994, No. 3, pp. 191-195.

Magrini et al., "Use of pyrolysis molecular beam mass spectrometry (py-MBMS) to characterize forest soil carbon: method and preliminary results," Environmental Pollution, 2002, pp. 5255-5268, vol. 116.

May et al., "Generation of Transgenic Banana (Musa acuminata) Plants via *Agrobacterium*-Mediated Transformation," Biotechnology, May 13, 1995, pp. 486-492, vol. 13.

Norris et al., "The intron of *Arabidopsis thaliana* polyubiquitin genes is conserved in location and is a quantitative determinant of chimeric gene expression," Plant Molecular Biology, 1993, pp. 895-906, vol. 21.

Suzuki et al., "Production of transgenic plants of the Liliaceous ornamental plant *Agapanthus praecox* ssp. *Orientalis* (Leighton) Leighton via *Agrobacterium*-mediated transformation of embryogenic calli," Plant Science, 2001, pp. 89-97, vol. 161.

Tingay et al., "*Agrobacterium tumefaciens*-mediated barley transformation," The Plant Journal, 1997, pp. 1369-1376, vol. 11, No. 6.

Tournier et al., "An efficient procedure to stably introduce genes into an economically important pulp tree (*Eucalyptus grandix* x *Eucalyptus urophylla*)," Transgenic Research, 2003, pp. 403-411, vol. 12.

Wenck et al., "High-efficiency *Agrobacterium*-mediated transformation of Norway spruce (*Picea abies*) and loblolly pine (*Pinus taeda*)," Plant Molecular Biology, 1999, pp. 407-416, vol. 39.

Abbott et al., "Simultaneous Suppression of Multiple Genes by Single Transgenes. Down-Regulation of Three Unrelated Lignin Biosynthetic Genes in Tobacco," Plant Physiol., Mar. 2002, pp. 844-853, vol. 128(3).

Aharoni et al., "Novel Insight into Vascular, Stress, and Auxin-Dependent and -Independent Gene Expression Programs in Strawberry, a Non-Climacteric Fruit," Plant Physiol., Jul. 2002, pp. 1019-1031, vol. 129.

Baucher et al., "Lignin: Genetic Engineering and Impact on Pulping," Crit. Rev. Biochem. Mol. Biol., 2003, pp. 305-350, vol. 38(4).

Boerjan et al., "Lignin Biosynthesis," Ann. Rev. Plant Biol., 2003, pp. 519-546, vol. 54.

Boudet et al., "Tansley review No. 80 Biochemistry and molecular biology of lignification," New Phytol., 1995, pp. 203-236, vol. 129.

Campbell et al., "Fungal Elicitor-Mediated Responses in Pine Cell Cultures," Plant Physiol., 1992, pp. 62-70, vol. 98.

Chapple et al., "An Arabidopsis Mutant Defective in the General Phenylpropanoid Pathway," Plant Cell., Nov. 1992, pp. 1413-1424, vol. 4(11).

Cheong et al., "Transcriptional Profiling Reveals Novel Interactions between Wounding, Pathogen, Abiotic Stress, and Hormonal Responses in Arabidopsis," Plant Physiol., Jun. 2002, pp. 661-677, vol. 129.

Christensen et al., "The syringaldazine-oxidizing peroxidase PXP 3-4 from poplar xylem: cDNA isolation, characterization and expression," Plant Mol. Biol., 2001, pp. 581-593, vol. 47.

Dean et al., "Forest Tree Biotechnology," Adv. Biochem. Eng. Biotechnol., 1997, pp. 1-44, vol. 57.

Dean et al., "Laccases Associated with Lignifying Vascular Tissues, in Lignin and Lignan Biosynthesis," ACS Symposium Series, American Chemical Society, Washington, DC, 1998, pp. 96-108, vol. 697.

Dixon et al., "Changes in the levels of enzymes of phenylpropanold and flavonoid synthesis during phaseollin production in cell suspension cultures of Phaseolus vulgaris," Physiol. Plant Pathol., 1978, pp. 295-306, vol. 13.

Effland, M.J., "Modified procedure to determine acid-insoluble lignin in wood and pulp," T.A.P.P.I., 1977, pp. 143-144, vol. 60(10).

Elkind et al., "Abnormal plant development and down-regulation of phenylpropanoid biosynthesis in transgenic tobacco containing a heterologous phenylalanine ammonia-lyase gene," Proc. Natl. Acad. Sci. U.S.A., Nov. 1990, pp. 9057-9061, vol. 87.

Evans et al., "Molecular Characterization of the Pyrolysis of Biomass. 1. Fundamentals," Energy & Fuels, Mar.-Apr. 1987, pp. 123-137, vol. 1(2).

Fukuda et al., "Lignin synthesis and its related enzymes as markers of tracheary-element differentiation in single cells isolated from the mesophyll of Zinnia elegans," Planta, 1982, pp. 423-430, vol. 155.

Gleave et al., "A versatile binary vector system with a T-DNA organizational structure conducive to efficient integration of cloned DNA into the plant genome," Plant Mol. Biol., 1992, pp. 1203-1207, vol. 20.

Goujon et al., "Down-regulation of the AtCCR1 gene in Arabidopsis thaliana: effects on phenotype, lignins and cell wall degradability," Planta, 2003, pp. 218-228, vol. 217.

Halpin et al., "Manipulation of lignin quality by downregulation of cinnamyl alcohol dehydrogenase," Plant J., 1994, pp. 339-350, vol. 6(3).

Hatfield et al., "Lignin Formation in Plants. The Dilemma of Linkage specificity," Plant Physiol., Aug. 2001, pp. 1351-1357, vol. 126.

Hosokawa et al., "Progress of Lignification Mediated by Intercellular Transportation of Monolignols During Tracheary Element Differentiation of Isolated Zinnia Mesophyll Cells," Plant Cell Physiol., 2001, pp. 959-968, vol. 42(9).

Hu et al., "Repression of lignin biosynthesis promotes cellulose accumulation and growth in transgenic trees," Nature Biotechnol., Aug. 1999, pp. 808-812, vol. 17.

Humphreys et al., "Rewriting the lignin roadmap," Curr Opin. Plant Biol., 2002, pp. 224-229, vol. 5(3).

Huntley et al., "Significant Increases in Pulping Efficiency in C4H-F5H-Transformed Poplars: Improved Chemical Savings and Reduced Environmental Toxins," J. Agric. Food Chem., 2003, pp. 6178-6183, vol. 51(21).

Kozlowski and Pallardy ($2^{nd}$ eds.), "Physiology of Woody Plants," Academic Press, San Diego, CA, 1997, Title and Index pages.

Lagrimini et al., "Characterization of Antisense Transformed Plants Deficient in the Tobacco anionic Peroxidase," Plant Physiol., 1997, pp. 1187-1196, vol. 114.

Lapierre et al., "Structural Alterations of Lignins in Transgenic Poplars with Depressed Cinnamyl Alcohol Dehydrogenase or Caffeic Acid O-Methyltransferase Activity have an Opposite Impact on the Efficiency of Industrial Kraft Pulping," Plant Physiol., Jan. 1999, pp. 153-163, vol. 119.

Liyama et al., "An improved acetyl bromide procedure for determining lignin in woods and wood pulps," Wood Sci. Technol., 1988, pp. 271-280, vol. 22.

Lu et al., "Derivatization Followed by Reductive Cleavage (DFRC Method), a New Method for Lignin Analysis: Protocol for analysis of DFRC Monomers," J. Agric. Food Chem., 1997, pp. 2590-2592, vol. 45.

Maher et al., "Increased disease susceptibility of transgenic tobacco plants with suppressed levels of preformed phenylpropanoid products," Proc. Natl. Acad. Sci. U.S.A., Aug. 1994, pp. 7802-7806, vol. 91.

Marita et al., "NMR characterization of lignins from transgenic poplars with suppressed caffeic acid O-methyltransferase activity," J. Chem. Soc., Perkin Trans. I, 2001, pp. 2939-2945.

Marita et al., "NMR characterization of lignins in Arabidopsis altered in the activity of ferulate 5-hydroxylase," Proc. Natl. Acad. Sci. U.S.A., Oct. 26, 1999, pp. 12328-12332, vol. 96(22).

McDougall et al., "Cell-wall-bound oxidases from tobacco (Nicotiana tabacum) xylem participate in lignin formation," Planta, 1994, pp. 9-14, vol. 194.

Osakabe et al., "Coniferyl aldehyde 5-hydroxylation and methylation direct syringyl lignin biosynthesis in angiosperms," Proc Natl Aced Sci U.S.A., Aug. 1999, pp. 8955-8960, vol. 96(16).

Pilate et al., "Field and pulping performances of transgenic trees with altered lignification," Nature Biotechnol., Jun. 2002, pp. 607-612, vol. 20.

Ralph et al., "Abnormal Lignin in a Loblolly Pine Mutant," Science, Jul. 11, 1997, pp. 235-239, vol. 277.

Ranocha et al., "Laccase Down-Regulation Causes Alterations in Phenolic Metabolism and Cell Wall Structure in Poplar," Plant Physiol., May 2002, pp. 145-155, vol. 129.

Schenk et al., "Coordinated plant defense responses in Arabidopsis revealed by microarray analysis," Proc. Nat'l Acad. Sci., Oct. 10, 2000, pp. 11655-11660, vol. 97.

Sederoff et al., "Unexpected variation in lignin," Curr. Opin. Plant Biol., 1999, pp. 145-152, vol. 2.

Sederoff, R.R., "Building better trees with antisense," Nature Biotechnol., Aug. 17, 1999, pp. 750-751, vol. 17.

Sewalt et al., "Reduced Lignin Content and Altered Lignin Composition in Transgenic tobacco Down-Regulated in Expression of $_L$-Phenylalanine Ammonia-Lyase or Cinnamate 4-Hydroxylase," Plant Physiol., 1997, pp. 41-50, vol. 115.

Smith et al., "Antisense RNA inhibition of polygalacturonase gene expression in transgenic tomatoes," Nature, Aug. 25, 1988, pp. 724-726, vol. 334.

Smith et. al., "Inheritance and effect on ripening of antisense polygalacturonase genes in transgenic tomatoes," Plant Mol. Biol., 1990, pp. 369-379, vol. 14.

Sun et al., "Independent modulation of Arabidopsis thaliana polyubiquitin mRNAs in different organs and in response to environmental changes," Plant J., 1997, pp. 101-111, vol. 11.

Thibaud-Nissen et al., "Clustering of Microarray Data Reveals Transcript Patterns Associated with Somatic Embryogenesis in Soybean," Plant Physiol., May 2003, pp. 118-136, vol. 132.

Wesley et al., "Construct design for efficient, effective and high-throughput gene silencing in plants," Plant J., 2001, pp. 581-590, vol. 27.

Whetten et al., "Functional genomics and cell wall biosynthesis in loblolly pine," Plant Mol. Biol., 2001, pp. 275-291, vol. 47.

Ye et al., "Determination of S2-fibril-angle and fiber-wall thickness by microscopic transmission ellipsometry," Tappi J., 1997, pp. 181-190, vol. 80(6).

Zhong et al., "Essential Role of Caffeoyl Coenzyme A O-Methyltransferase in Lignin Biosynthesis in Woody Poplar Plants," Plant Physiol., Oct. 2000, pp. 536-577, vol. 124.

* cited by examiner

Figure 1: Amino Acid sequence of SeqID 268. The conserved glycoside hydrolase, family 1, domain is underlined and the glycosyl hydrolases family 1 active site is in bold.

MKMGTMIVFLFLYINLCMAEQFVWQPGQEIDTSGL<u>SRASFPKGFVFGTATS</u>
<u>AYQVEGAAKSDGRGPSIWDTFITQPGIVANNATADITVDEYHLYKSDVELMV</u>
<u>KMNMDAYRFSISWSRIFPKGAGRINYKGVQYYNNLINYLLKRGITPYANLYHY</u>
<u>DLPEALETAYGGLLNSRVVEDYAKFAEFCFKTFGDRVKYWMTFNEPRVVAA</u>
<u>LGYDNGIFAPGRCSAPFGNCTAGNSATEPYIVAHNLLLSHATAVKIYREKYQ</u>
<u>PMQKGKIGILLDFVWYEPLTNSSEDQGAAQRSRDFHIGWFLHPITYGKYPDS</u>
<u>MVEIVGTRLPKFTKEQSQMVKGSIDYLGVNQYTAYYMYDPKQPKQNVTDYQ</u>
<u>MDWNTGFAYARNGVPIGPRANSNWLYIVPWGLYKAVTYVKEHYGNPTMILS</u>
<u>ENGMDDPGNVTLPAGLHDTIRVNYYKSYLQNLINAVNDGANVVGYFAWSLL</u>
<u>DNFEWKSGYTSRFGVVYVDFTTLKRYPKMSAYWFSKLLQRH</u>

Figure 2: Amino Acid sequence of SeqID 269. The conserved glycoside hydrolase, family 1, domain is underlined and the glycosyl hydrolases family 1 N-terminal signature is in bold.

MPKMSTSLFFVAVTALTLTILQRSEAQCDPNSTVDF<u>KRKSFPPG**FVFGTASS
AFQYEGA**VKEDGRGASVWDTYSHKFGRILDFSNADTADDQYNRYRKDMEL
MVDLGMDAYRFSISWSRIFPNGSRDINQAGVDHYNKFIDALLEKGIKPYVTLY
HWDLPQALEDAYKGWLNSNIIEDYANFAETCFEKFGDRVKNWMTFNEPHTV
SVQGYDAGLFAPGRCSVLLHLFCRAGNSATEPYIVAHNILLSHAKTVDIYRTK
YKAKQGGRIGIALDVIWYEPMSDSPEDIAATQRAQDFQLGWFMHPLFFGDY
PASMRERVGNRLPLFSSEESNQIKGSLDFVGINHYTTYYARNNKTHITSALLN
DTLSDSGVVTLPFKNGRAIGDKASSIWLYIVPQGIRSLMNYIKRRYNNPPVIIT
ENGMDDPNNILIPLKKALNDQKRIKYHADYLSNLSAAIKEDGCNVGGYFVWS
LLDNWEWAAGYTSRFGLYFVDYRHNLTRHPKASVQWFKCFLTP</u>

Figure 3: Amino Acid sequence of SeqID 270. The conserved glycoside hydrolase, family 1, domain is underlined and the glycosyl hydrolases family 1 N-terminal signature is in bold.

MALTVEAPAALHLQEEESENVKEI<u>SRDKFPESFEFGVATSAYQVEGAAKGG</u>
<u>GRGPSIWDTFSYTPGKIIDGRNGDVAVDQYHRYKEDVDLIAKMGFNVYRFSI</u>
<u>SWSRIFPDGFGAEVNKEGIAYYNNLIDTLLQKGVRPSVTLYHWDLPQKLHES</u>
<u>MGGWLNREIVNYFALYAETCFSAFGDRVKQWITLNEPLQTAVNGYATGIFAP</u>
<u>GRCSDRSQSPVGDSSTEPYLVAHNQLLAHAAAVDIYRKKFQDKQGGVIGITV</u>
<u>DGEWAEPFTDAEGDKEAAQRRREFQFGWFLDPIYFGDYPAIMRKKLGDRL</u>
<u>PQFSPDEVAVLRGSSDFLGLNHYTTRYVIPSFRDSKKDEFYVDQDIHSIAEW</u>
<u>EGNTIGERAASEWLYIVPWGFRKVLKWLTERYNRPPIYVTENGMDDEDSEIT</u>
<u>LLDQALNDTKRVNYFKGYLKALAEAIREGADVRGYFAWSLIDNFEWGQGYT</u>
<u>KRFGLVFVDYKDDLKRYPKSSAHWFTSFLHGTDKQACLVNGENGR</u>

Figure 4: Amino Acid sequence of SeqID 271. The conserved glycoside hydrolase, family 1, domain is underlined and the glycosyl hydrolases family 1 N-terminal signature is in bold.

MSINIADMRIVGSIIVLELLILLSLSAVSAYTQHL<u>SRNYFPPDFIFGVASSAYQY</u>
<u>EGAAAEDGRKPSIFDTFTHRKGTTMDGGNGDVAVDQYHRYKDDIDLMSAM</u>
<u>GVDAYRFSISWPRLIPDGKGPINPKGIEYYNNLINELLANGIQPHVTLYHFDLP</u>
<u>QALEDSYGGFINPQIVEDFVLYADVCFREFGDRVKYWSTFNEPNIFAIIGYDG</u>
<u>GFFPPQRCSQPFGNCTAGNSTVEPYIVGHHVLLAHSAAVELYRKKYQAKEK</u>
<u>GWIGLVILANWMIPLTNKSTDVAATQRANDFMLGWFLDPLVLGNYPVGIRNV</u>
<u>VGSRLPSFTEEQAQKIRGSLDFIGVNHYFTMYCFDVPRKNAPMSRDYAQDM</u>
<u>SIGYAVERDGIPISNTTTLNGNPVLPQSMQAVLEYIEDRSHNTPILVYENGFA</u>
<u>EPNNSSIPLSEALNDQYRIDLHRDVLSYVLAAIRNGSDIRGYFIWTLLDDFEVL</u>
<u>TSYTWRFGLHYVDFNDNLKRYAKLSAHWYKTFLQRRDSKGSQILLNTNSFM</u>
<u>NLS</u>

Figure 5: Amino Acid sequence of SeqID 272. The conserved glycoside hydrolase, family 1, domain is underlined and the glycosyl hydrolases family 1 N-terminal signature is in bold.

MSPSLLYIAANIFLLTALQRSEAQCGPTSTVDF<u>NRRDFPPGFVFGTASSAFQ</u>
<u>YEGAVKEDGRGPSVWDTYSHKFGHILDFSNADVAEDQYHRYREDIQLMVD</u>
<u>MGMDAYRFSISWSRIFPNGNGDINQAGVDHYNKFIDALLQNGIEPYVTLYHW</u>
<u>DLPQALEDAYKGWLSPKIIDDYAKFAETCFEKFGDRVKNWITFNEPHTVSVQ</u>
<u>GYDAGLFAPGRCSVLFHLFCRAGNSATEPYIVAHNILLSHAKAVDIYRTKFKA</u>
<u>KQGGRVGMALDVIWYEPMSESPEDIAATQRAQDFQLGWFMDPLFFGDYPA</u>
<u>SMRERVGNRLPLFSSEESSQIKGSVDFVGVNHYTTYYVKHNETDIISVLLND</u>
<u>TLADSGSLALPFKDGKAIGDKASSIWLYIVPQGIRSLMNYIKQRYNNPPVIITE</u>
<u>NGMDDSNNIFIPLKKALKDQKRIKYLTDYLSNLAAAIKEDGCNVGGYFVWSLL</u>
<u>DNWEWAAGYTSRFGLYFVDYKHNLTRYPKDSVQWFKCFLAP</u>

Figure 6: Amino Acid sequence of SeqID 273. The conserved glycoside hydrolase, family 1, domain is underlined and the glycosyl hydrolases family 1 N-terminal signature is in bold.

MEVSVLMWVLLFYSLLGFQVTTARL<u>DRNNFPSDFMFGTASSAYQYEGAVR</u>
<u>EDGKGPSTWDALTHMPGRIKDSSNGDVAVDQYHRYMEDIELMASLGLDAY</u>
<u>RFSISWSRILPEGRGEINMAGIEYYNNLIDALLQNGIQPFVTLFHFDLPKALED</u>
<u>SYGGWLSPQIINDFEAYAEICFRAFGDRVKYWATVNEPNLFVPLGYTVGIFP</u>
<u>PTRCAAPHANPLCITGNCSSAEPYLAAHHVLLAHASAVEKYREKYQKIQGGS</u>
<u>IGLVISAPWYEPLENSPEERSAVDRILSFNLRWFLDPVVFGDYPQEMRERLG</u>
<u>SRLPSISSELSAKLRGSFDYMGINHYTTLYATSTPPLSPDHTQYLYPDSRVYL</u>
<u>TGERHGVSIGERTGMDGLFVVPRGIQKIVEYVKEFYDNPTIIITENGYPESEE</u>
<u>SSSTLQENLNDVRRIRFHGDCLSYLTAAIKNGSDVRGYFVWSLLDNFEWAF</u>
<u>GYTIRFGLYHVDFISDQKRYPKLSAQWFRQFLQHDDQGSIR</u>SSSSI

Figure 7: Amino Acid sequence of SeqID 274. The conserved zinc-containing alcohol dehydrogenase superfamily domain is underlined and the zinc-containing alcohol dehydrogenases signature is in bold.

MGSLETEKTVTGYAA<u>RDSSGHLSPYTYNLRKKGPEDVIVKVIYCGICHSDLV</u>
<u>QMRNEMGMSHYPMVPGHEVVGIVTEIGSEVKKFKVGEHVGVGCIVGSCRS</u>
<u>CGNCNQSMEQYCSKRIWTYNDVNHDGTPTQGGFASSMVVDQMFVVRIPE</u>
<u>NLPLEQAAPLLCAGVTVFSPMKHFAMTEPGKKCGILGLGGVGHMGVKIAKA</u>
<u>FGLHVTVISSSDKKKEEAMEVLGADAYLVSKDTEKMMEAAESLDYIMDTIPV</u>
<u>AHPLEPYLALLKTNGKLVMLGVVPEPLHFVTPLLILGRRSIAGSFIGSMEETQ</u>
<u>ETLDFCAEKKVSSMIEVVGLDYINTAMERLEKNDVRYRFVVDV</u>AGSKLDN

Figure 8: Amino Acid sequence of SeqID 275. The conserved zinc-containing alcohol dehydrogenase superfamily domain is underlined and the zinc-containing alcohol dehydrogenases signature is in bold.

MAMCRSALILPVDFRLIPSHFLRRHTIRTCCLHYYSFIQQSPPFIIHDSISAALQ
TPPRLKVSRRCGNPIPLAMATKADCEESGRTMRAMVLESPKTLLKSVMLNIP
EPAEGHVRVRVSACAVCRTDLHVVDGDLDKPKLPIIPGHEIVGVVDKVGKGV
DSNLFSIGKRVGIPWLGRTCGKCTYCLEGAENLCDDPAFTGYQIDGGYAEY
AVAHASYCFPLPEIYSDIEVAPLLCAGLIGYRSLRKTGFKPGLDKKKRIGIYGF
GAAAHIIAQVAIHEGHQIYAFTRAGDKEAQAFALRLGAIWAGDSMSLPPHELD
AAILFAPVGLLVPAALKAVRKGGIVVAGGIHMSQIPAFPYSILWGERQVVSVA
NLTRQDALEFLELAPKACVKTETVVFPLEKANEALASLREGRLEGAAVLVP

Figure 9: Amino Acid sequence of SeqID 276. The conserved zinc-containing alcohol dehydrogenase superfamily domain is underlined and the zinc-containing alcohol dehydrogenases signature is in bold.

MNTKEDSNVNCSGWAA**RDPSGVLSPYQFNRRVPGLDDISLKITHCGVCYAD
VAWTRNKVGDSKYPLVPGHEIVGIVKEVGINVIRFKVGDHVGVGTYVNSCQ
QCEYCNERMEVNCAEGSIYTFNGIDVDGTVTKGGYSSHIVVHQRYCFKIPDN
LPLASAAPLLCAGITVYSPMIRHHMNHAGKSLGVIGLGGLGHMAVKFGKAFG
LNVTVLSTSASKKDEALSILGADKFLLSSDKQQIEASSKTLDFIIDTASGDHPID
LYMPLLKTSGVFVIVGFPSEIKIHPDNLIIGMKSIAGSITGGTKDTQEMLDFCAK
ERVYPNIEVIPIQYINEALERMINKDVKYRFVIDI**ENSLVSN

Figure 10: Amino Acid sequence of SeqID 277. The conserved zinc-containing alcohol dehydrogenase superfamily domain is underlined and the zinc-containing alcohol dehydrogenases signature is in bold.

MASALSPQTITCKAAVA<u>WGPGEAMSIEEVQVAPPQLKEVRIKVVATSICRSDI
TLWESRGHTPIFPRIFGHEATGIVESVGEGVTDLREGDHVLTVFQGECKNCR
HCKSDKSNACETLGIERNGLMHGDQKSRFSINGKPIYHFVAVSSFSEYTVVH
SECVVKLSPDVPLGKISVLGCGVATGFGAAWKIANVKGSTVVIFGLGAVGL
AVAQGAKLRGASRIIGVDINPDKFERGKAFGVTEFINPSDYKQPTQEVVKEIT
TGGADYCFECVGDVELMRTALESCCDGWGMAVLIGVPSGKMELSAHYGPL
LGGRTLKGTLLGGWKTRSELPLLVEMYMKKEIQIDEYVSHELPFADINKAYQ
LMKEGKCLRCVLHVGN</u>

Figure 11: Amino Acid sequence of SeqID 278. The conserved zinc-containing alcohol dehydrogenase superfamily domain is underlined and the zinc-containing alcohol dehydrogenases signature is in bold.

MSESYKFQGWMGVDK<u>DATKGKMVWQEFEPKAWEERDVDVKITHCGICGS
DLHTLRSGWGATDYPCCVGHEVVGTVAKVGSEVKGIKVGDRVGVGAQTDS
CGECEDCKDGRTQHCAKSVGTYAAKHYNGGKSYGGYADYWRGPATCMV
KIPDSIPSAEAAPMLCGGVTVWSPLKNNGAGPGKKVGVVGVGGLGHFAVLF
AKALGCDEVVAIQRNTKKKDDIMKMGATKLIATDEEEDWNKKHGRSLDLIVS
TVSSPKAPFAKYLQLLKPRGNFIQVGAPEDVFPPLAAFSLIGNEIKFGGSIIGS
PSDIKEMLDFVEKKGIKPWIQERPMKDANKTVVDMDNGEARYRYVLVNEKHI</u>

Figure 12: Amino Acid sequence of SeqID 279. The conserved UDP-glucoronosyl/UDP-glucosyl transferase family domain is underlined and the UDP-glycosyltransferases signature is in bold.

MEAQSVSVVEQRPHALLFSFPLQGHIKPFMNL<u>AKILSSRGFYVTFASTEFVV
KRLAECGESIAHRDSTVCSENDDVCNIKFETVPDGLPPHHDRSTQNLAELFQ
SMEENAHIHFHKLMEKLQNLREVPPVTFIVTDGLLSKTQEIANEYGVPRVAF
WTTSACGFMAYFSIPLLIKKGYLPLKDECCLSSEYLDEVRITCIPGMPPLRLK
ELPSFCLVTDPSDFFFQNAINQVQGTLTADGLILNTFDELEGPVLEALSLHFP
VYAIGPLLLSQSFHCKDKGGSSDELSLWKEESGCLTWLDTRKPCSVLYVCL
GSLAVMSNEQLLEFAWGLASSNQSFLWVVRSDIVHGESAILPKEFIEETKDR
GMLVGWAPQIKVLSHPSVGGFLTHSGWNSTLESISAGVPMMCWPFFAEQ
ETNAKFVCEEWGIGMQVKKMVKREELAILVRNLIKGEEGDEMRKRIGKLKET
AKRAVSEGGSSKNNLDKLLHHIFLKG</u>MHQMIVQNVEANN

Figure 13: Amino Acid sequence of SeqID 280. The conserved UDP-glucoronosyl/UDP-glucosyl transferase family domain is underlined and the UDP-glycosyltransferases signature is in bold.

MAANAERRPHVLVFPFPAQGHMIPLLDLTHTLACGGLSLTVLTTPQNQPLLD
PLLHKASVEGLSIQPLVIPLPPTKGLPPGYENLAQIPLHLVLLLMASFKELAHPI
EDWFQQQKDSDYGFGPPVCMISDFFLGWTYDTATKLGIPRIVFHPCGAFDAI
LHYSLWKYMPGILESDDDEVHFLEAPHPVSFAKHQISSLGLLYKKSDPVSEFI
RYSMNLNVKSWGNIINTFYDLEAVYMDQLHRVSGSPVWSVGPLFPPAMFDP
KLRRTMIERGKPSSINDSLLQQWLDSRGEKSVIYICFGSQACLSNKQIEEMA
AGLEATEESFIWVMRDLPSGLPADEYGALPQGFEERMEGRGLIIRG**WAPQL
LILSHPSVGGFLTHCGWNSTLESITMGVPLITWPLAADQ**YYNARLLVESLKI
GVRFCEGATTVPNRDDLRIAIKRLLGREGEEMKRAEELSKAARTAVQEGGT
SYRNIEALVSEIKKLILQPS

Figure 14: Amino Acid sequence of SeqID 281. The conserved UDP-glucoronosyl/UDP-glucosyl transferase family domain is underlined and the UDP-glycosyltransferases signature is in bold.

MGSSLVFDYSQLRVLVVPYPAQGHMNPMLQFAKRLASKNLEVTFVITEASR
KSMLEAQGAVWGASEKREEIQFETISDGLAADVDRNNVEIVSDMLSKIGEVT
LGNLVERLNAQGNQISCIVYDSFLAWVPKVSKKFSIPSAFFWTQSCAAYLVY
YHFFIKLAAEWHEMLKTTEVIEIEGLPPLSHSDLPSFLLPANPFRSILRLGVQQ
FQFLPEVTWVLGNSFHEMESEENNSIKSVRPFRTVGPAIPSAFLEGRNPGET
DSGANLWKTINCTDWLNRKEPARVVYVSFGSLAVLSKEQTHEIALGLKASGY
PFIWVIRPSSSKEEIHNDENLPEGFLEETSDQGLIVP**WCPQLEVLSHVSVGA
FMTHCGWNSTLEGLSSGVPMLAVPQWSDQ**MLNALYIEEKWKTGLRLSKRS
ADGLVEKAEVEKCIRMVMETERGVEMKKNALRWKTLAREAMAEGGSSDKN
IEEFIEEIATAKASSMSG

Figure 15: Amino Acid sequence of SeqID 282. The conserved UDP-glucoronosyl/UDP-glucosyl transferase family domain is underlined and the UDP-glycosyltransferases signature is in bold.

MIMASLMGFDYSKLHVLVVCYPAQGHINPMLQFAKLLASKNVGVTFVTTEAC
RKSIIEAQDAVLGGSKKREEVRFETISDGLTSDSERRDVEVVLNMLFEIGGEA
LGNLIERLNSEGNKISCIVLDSFLTWIPGVAKKFNIPSAFFWTQSCAVFSIYHH
FIVGDMAAAWDETWETVDAIEIPGLPPLRVSDMPSFLLPSNPHPTLSRFVVE
QFQSLPESTWILGNSFQELESEEINSMKLIAPIRTVGPLIPSAFLGSRNPGDT
DVGANLWRSANCTDWLDRKQPASVVYVSFGSLAVLSKEQTCEIALGLKASG
HHFIWVIRPSASDGGMTSYKNLPEGFLEEISEQGLVVP**WCQQLQVLSHESV
GAFMTHCGWNSTLESLSLGVPMLAVPQWSDQ**ITNSTWVERKWKMGLRVN
KRSADGLVEKEEVEKCVRMVMETERGVEMRENASQWKTLAREAMAEGGS
SDKNIEDFIEEIAAKSLRISGSGVPI

Figure 16: Amino Acid sequence of SeqID 283. The conserved UDP-glucoronosyl/UDP-glucosyl transferase family domain is underlined and the UDP-glycosyltransferases signature is in bold.

MGYLQGLDYSMLHVLVVPFPGQGHINPMLQFAKRLSSKNLQVTFVTTEANR
KRMLQSQDTTSEASDKRGEVRFETISDGLTSDSERGDVVIVSAMLYKVGGL
MLGNLVERLNAEGNQISCIVQDSFLPWVSDVAKKFNIPSVFFWTQSCAVYAF
YHHSVYGKLATSLDGTQNEAAVVEIPGLPPVSVSDLPSLVQPSNPYGSLWQ
LIVDQFKSLPEATWVLGNSFEELESDEIKSMKLVAPMRTVGPLIPSAFLDGRN
PGDKDPGAQLWKTTNCMDWLNTKESASVVYVSFGSLSVLSKEQNHEIAFGL
KASGYSFIWVMRPSSSTGNVDSDENFPEGFLNETSEQGLVVPWCPQLEVL
SHESVGAFMTHSGWNSTLEGLSLGVPMLAVPQWSDQTTNSLYIAEKWKTG
LRLTKRSADGLVGKEEVEKGIRTVMETESGIEMRKNALRWKTLAREAMMEG
GSSDKNIEDFVEEIAHKVRLF

Figure 17: Amino Acid sequence of SeqID 284. The conserved UDP-glucoronosyl/UDP-glucosyl transferase family domain is underlined and the UDP-glycosyltransferases signature is in bold.

MDECEGKTGMH<u>AILVPLPGQGHINPAMQLAKKLASKGISITFVLTQSWHNIIT
HAHSTKGSNAFNHAQNLGLDIRLVAIPDCLPGEFERWNKIQEFFRSLDNMES
HVEELIKNLNQSSAAPVSCIVADTMLGWAVPLAKKLRLLSVSFWTQNVSVFS
ITYNSYLEERRAESVIHIPGVTPLQPADLPFWLTRSPDNVIARVVARCFQTVR
EADVVVANSFQGLEGHVVEALWEKMRVYCVGPLLPSAYLDRSDPRDSVVG
TSYRVEMDCTRWLDDKPPKSVIYVSFGSLLPMSKSQIEEIAMGLKESDYSFI
WVLRHSSKECTEVSSMLPDGFLKETKERGVVV**PWCSQLKVLSHPSIGGFFS
HCGWNSTLESIAFGLPILGFPLGVEQ**FTNCNLIADEWKIGLRLRSGNDTDKVI
GRVEIAENVKRLMEGEEMRRAAERLRDVVKIEVREGGTSDSNLECVVEGLN
AKLSENKILSTSSPNGIL</u>

Figure 18: Amino Acid sequence of SeqID 285. The conserved UDP-glucoronosyl/UDP-glucosyl transferase family domain is underlined and the UDP-glycosyltransferases signature is in bold.

MENENGRRATHPHVMMLPSLGHGHLIPFMHLIPFMHLTKKLATRG<u>FTVTFVV</u>
<u>TFHHKSSLLKKVEAARETGLDIQMVEMEVPRDDLALGKVNSNSTRLRHELPP</u>
<u>LLAANELMESSFERFLQRFMGGRFCSTGPPLSCLIADMLLGWASAVAKKFNI</u>
<u>PTVCFLIGGMYSNGVIVSMSEVLPRNLRRTPSGRYIVPGLPKEVRLTGLQML</u>
<u>PEATELTTESAIHQFNIRVIEGNDQSWRFIANTFYDLEADFVEYFQKRGSSIV</u>
<u>VRTIGPLLPPEAFGNSPTKIDPLVEMGVNKESEESEECLDWLDRQKEESVLY</u>
<u>ISFGSENSISSAQTEELAMGLEASRVKFVWVLRIPSDAGSKSFSSALDFLPQ</u>
<u>GFRSRMVEEEKQGFIVLGWAPQLSILAHPAIAGFLSHCGWNSVLETITMGV</u>
<u>PMISWPLFADQYYNSKFVVDEIQIALEAPKRTEQNWLVPRDEVERIVKLLIMG</u>
<u>ERGRELRKRVRELKMAARAAVAEGGSSYSNFDLFVSEIMSLSL</u>

Figure 19: Amino Acid sequence of SeqID 286. The conserved UDP-glucoronosyl/UDP-glucosyl transferase family domain is underlined and the UDP-glycosyltransferases signature is in bold.

MAPHVLVIPYPVQGHINPLIQLSEMLSSKGILVTFINTECNHSKMMKARSYHD
WNSVGPNSNIHFSQVSDGLPLDFDRAANSSEFYRCIRNEMRDSVEGLIQSH
LNAETGKPPFSCIISSSFLTWAFHVGKKLELPFIAFWSQSVSVYTIYRHLSMII
SNCHFPPKKEDPKDIIDYIPGLPPLQPEDLPQDIQTGDASSGFHRLVVEQLSL
LEETEWIIGNTVYELEREASDAVQEAAAPICSLGPFLPSVYLESECKHKEISV
NSTSLSLWEEKDCSQWLDSKARSSVLYVSFGSLARMSKTQVEEIAMGLLES
GQNFLWVVRPGMLGSDDDGDVLPEGFLEKTKNRALLI**PWCTQLSVLSHPSL
GGFFTHGGWNSTLESLSLGVPMLVFPQATDQ**YTHRMLVVNQWKIGLRLAK
CRDDGVIERGEISRAVKLLVGSKEGEEMRRKSKEIRETIRQTTSEGGSSWIN
MQRLLDYIGTTSTEPVRSEI

Figure 20: Amino Acid sequence of SeqID 287. The conserved UDP-glucoronosyl/UDP-glucosyl transferase family domain is underlined and the UDP-glycosyltransferases signature is in bold.

MAHNSEPLH<u>ALVIPHPTQGHMNPMMQFAKNLASKGLSVTFVTTHHTQQQIIK</u>
<u>AHSQTDQVDPIDAHNMDGDIRSAQISDGLPLDFDRSAGFSEFMRSVEKMGG</u>
<u>ELERLIHDLNETGPPVSCVIADTMLFWSLQVTKKFGIPWISFWTQPTVVYSIF</u>
<u>YHSHLVEAQRQSHDKTSGDEVDNLIDYIPGVPTLHPRDLPSFFNETDADSLY</u>
<u>LLDLFRKSLQSSREADWVLCNSFDDLESATVNASMKLEPPVFRVGPLLPSG</u>
<u>YLKGESPDENMRTGTSLCTEHDCSEWLNTKPNGSVIYVSFGSLIHVSKDQL</u>
<u>KEIAMGLRDGRQPFLWVLRPDIVASTVSDLLPDGFLDEVGSQGLVVPWCNQ</u>
<u>LQVLSHSSVAGFITHCGWNSMLEAIALGVPMLGFPFWADQFTNCKFMADE</u>
<u>WKLGFRVSGVAHGEDNRMIDRKDISSAIRKLFTDEGNEMKKKVAAIKESART</u>
<u>AVRTGGSSDKNMDSFIMGLKALN</u>AKPQGKQY

Figure 21: Amino Acid sequence of SeqID 288. The conserved UDP-glucoronosyl/UDP-glucosyl transferase family domain is underlined and the UDP-glycosyltransferases signature is in bold.

MESTGNCGGF<u>HALVVPLPGQGHINPMMQLAKKLASMGISITFVLTNSWHQII</u>
<u>TDAHFGHGVDAFAHARNLGLNIRMVAIPDCVPGEFERWSKIQQFYGSLGNM</u>
<u>EGPVEELIHDLHRQPNVTPVSCIVADTYLTWAVPLAKKLNMLSISFWTQSISM</u>
<u>FSILHHSELETFQAGSVIHVPGEISIQPAELGSFLKDPANTRAVVQCLERARE</u>
<u>ADWVVANSFQALEGDVVEALSEKLQVYCVGPLLPSAYLDQSVSRDFVVGTS</u>
<u>SRVEIDCTKWLDDQRPKSVIYVSFGSLITVSARQVEEIAMGLKESSYCFMVV</u>
<u>LRHPGPEATEVSAMLPEGFLKETKERGLIVPWCSQLKVLNHPSIGGFLSHC</u>
<u>GWNSILESISSGIPLLGFPLGNDQYTNCRLLADERKIGLRLKSSNDTEKVVG</u>
<u>REEIAEKVRRLMEGEELRRTAERLRDVVQMEVKNGGTSNKNLEIVANGLKT</u>
<u>KLM</u>

Figure 22: Amino Acid sequence of SeqID 289. The conserved UDP-glucoronosyl/UDP-glucosyl transferase family domain is underlined.

MELEKRSIKAH<u>VMVLSYPATGHTNPMLQFSKNIASRGLLVTFVTFSYNHHKVI</u>
<u>QAKDSLRRLNLPIQFECIPDGLPQDHTLDSNVNNVVFNHMRNNMDGSTLER</u>
<u>LIHRLNTRGNAPPVCCIVYNPFLPWARQVAKKMNIPHALFWTQSTALFSIYYH</u>
<u>FNNSSGEKWDSRQMAESVSVSIPSLPELKLGDLPSAFTDTEERLQIYLHQLD</u>
<u>GLSDVSWVLANTFYELEAQTIDLMRSRFGVPFSSIGPCIPSAFLDGRNPHDA</u>
<u>RVGADPWTATDKVQEWLDRKPPSSVVYISFGSITVINPQQIHELALGIESSQ</u>
<u>QNFLWVIRPPPGHDDITEFFPAGFVEKTEGRGLVVSWCVQLEVLSHRSVAA</u>
<u>FMSHCGWNSTLEALSLGVPVLTLGVWTDQTTNSKFLADVWKAGVRMRKGE</u>
<u>DGTVGRDEIERCMRMAVDKRSKAGEEHQKNAVKWKQLAKSAMNEGGSFD</u>
<u>TNLNEFVEDVVSIA</u>TRSFPPPS

Figure 23: Amino Acid sequence of SeqID 290. The conserved UDP-glucoronosyl/UDP-glucosyl transferase family domain is underlined and the UDP-glycosyltransferases signature is in bold.

MSIENVDCALH<u>AVIVPFPAPSHVNALMNLTQLLTNRGFFITFVNTEWLHKRIV</u>
<u>QVSAGNTNSLISSELEQRRSKIRFLCIPDGLPPEHSRLSNLGEYVRAMQKLS</u>
<u>PALEQLIRSSGATGDDGQYSFPPITCIVTDCFMSCTDQVATNMKVPRVIFWP</u>
<u>FCAAASICQLYTQFLVSQGHIPVKISEANNPGKVITCLPGNLPPMRPTDLMYL</u>
<u>YRAEDPTDILLNALVYESEKQRKGDYVLVNTFEELEGRDTVTALSLNGCPAL</u>
<u>AIGPLFLPNFLQGKDCTTSLWEEDEACLSWLDMQQTASVIYVSFGGLAIKSQ</u>
<u>EQLQQLALGLECSGQPFLWVLRSDIEDGKPAVLPDGFEERTKGRALLVRWA</u>
<u>PQVKVLAHTSVGLFLTHAGWNSTLETISMGVPVVSFPYFADQYLNCRFAKD</u>
<u>VWEMGLDFEGVDVDDQKVVSKEEVEDRVKRMMRTKEGKQLRENAVRLKE</u>
<u>CARRAVVHGGSSFNNLNTFVNDMARKT</u>TARSQNETK

Figure 24: Amino Acid sequence of SeqID 291. The conserved UDP-glucoronosyl/UDP-glucosyl transferase family domain is underlined and the UDP-glycosyltransferases signature is in bold.

MGSLGELEYNKPHVLVMPYPAQGH<u>NPMLLFAKKLASKQMMVTFVTTEEKR</u>
<u>VRMLQAQDSLPGASNSSMEVKFETISDGLPVDFDRSKDVDMVLDLLSKMG</u>
<u>GLTLANLIERLNAQGNNISCIVYDSFLHWVPDVAKKFNIPVAFFWTQSCAVYS</u>
<u>IYYNFSGGLANLRDETGKTVDAIEVPGLPLRKVSELPSFLHPSNTQESLLRLV</u>
<u>MDQFKLLSEATWVLGNSFSELESEEINSMKSLAPIRTVGPLIPSAFLDGRNP</u>
<u>GDTDPGAHLWKTTNCMDWLNTKEPASVVYVSFGSLAVLSKEQMHEIALGLN</u>
<u>ASGYSFLWVVRPPSSKWEINSEENLPAGFLNETSGQGLVVPWCHQLQVLS</u>
<u>HASIGAFMTHSGWNSTLESLSLGVPMLVIPQWSDQSTNSAYVAEKWMVG</u>
<u>MRLKERSENGLVGREEVEKCIKIVMESQLGAELRKNALLWKKLSREAMVKG</u>
<u>GSSDRNIQEFVDEVVARA</u>WSSSLSGQDFIV

Figure 25: Amino Acid sequence of SeqID 292. The conserved UDP-glucoronosyl/UDP-glucosyl transferase family domain is underlined and the UDP-glycosyltransferases signature is in bold.

MESSGGLLYSNL<u>RVLVVPYPRQGHINPMLQFAKRLASKNLQVTFVTTEENR
ERMLRAQDAVPRPPNKSVNLQFETISDGLPLDFKRSKDRQMRFDMLCRMG
GLTLANLIERLNAKGSNICCIVYDALLSWLPEIAKKFNIPLAFFWTQSCAVYSIY
YHFKRGLAITGDGTEKPTDLIKIPGLPLLKVSDLPSFVQPSNSDGFLSRIFLDQ
FNSLSEATWILGNSFEGLEYEEINSMKSIAPIRTVGPLIPSAFLNVQNDDDTDF
GADMWKTTNCMDWLNTKEPASVVYISFGSIAVLSAEQTEEIALGLKASGYSF
IWVIRPSSSNEVINSEENLTEGFLAEISGQGLVV**PWCPQLQVLSHASVGAFM
THCGWNSTLESLTMGVPLLAVPQWSDQ**TTNSRYIGEEWKTGLRLDKRSAD
GLVGKEAVEKCIRMVMEGELGAELRENALRWKKLSREAMGEGGTSNGNIE
EFVKDIVGRASSSSLSSG</u>

Figure 26: Amino Acid sequence of SeqID 293. The conserved multicopper oxidase, type 1, family domain is underlined and the multicopper oxidases signature 2 is in bold.

MLLCACPGVKYWLIVILLMVIQYLDIAAGKH<u>ESTTRHYKFNVRLKNVTRLCHS
KPLVTVNGRYPGPTIFAREGDRVIIKLVNHVKDNVTIHWHGVRQLRSGWAD
GPGYVTQCPIQTGKSYVYNFTITGQRGTLWWHAHISWLRVSVYGAIIIYPKLH
VPYPFPKPHKEVPVILGEWWNANTEKVIQQALQTGGGPNVSDAYTINGLPG
PLYNCSNETFVLKVHPGQTYLLRIINAALNDELFLAIANHSLTVVEVDAVYVKP
FQTDTLLITPGQTTNVLLTANATSGKNKQFVIAASPFVTGSGTFDNSTVAGIV
SYNSHKFKNSSTIILPKLPSFNDTNFAANFSAKLKSLANSQFPALVPQKVDRK
FLFTVGLGLNPCPVGVGNTTCQGPNGTKFTASVNNISFVLPSTALLQSHYFN
QIKGVYKTNFPDNPPFPFNYTGTPPNNTKPMNGTRVKVIPFNTTVQLVLQDT
SIAGTESHPFHLHGFNFFVVGQGVGNYNESKDAPNFNLVDPVERNTAGVPK
GGWMAIRFRADNPGVWF</u>MHCHLEIHTSWGL<u>KMAWIVKNGK</u>GPLQSLPPPP
SDLPPC

Figure 27: Amino Acid sequence of SeqID 294. The conserved multicopper oxidase, type 1, family domain is underlined,The multicopper oxidases signature 1 is in bold and the multicopper oxidases signature 2 is in bold/italics.

MSLQPVCAFRLLFLISFVACLAAIT<u>NADVHRYTFIIEPKNITRLCKTYELVVVNG
QLPGPTIHVRNGDSLIVKVYNRAKYNATIHWHGVRQLRTGWADGPGYITQC
PIQPGGRYTYRFNITDQVGTLWWHAHVSWLLATVHGAFVIYPKKQSSYPFP
KPHGETPLIIGEWWNADPIAVIDEALRTGGAPNLSDAYTLNGQPGDLYNCSR
AGTFRFPVKQGETYLLRMVNAALNSAHFFKIAGHKFTVVAVDASYTKPYKTD
IIAIAPGQTTDVLVTADQPVGRYYMAARDYNNQGTGAFDNTTTTAIFEYVGH
QNTRPILPKLPYYNDTAVVTRFSTALRSLNSKDFPVDVPHSIDDSLIATVGLG
LLPCEAGNTCQGPNGTRLSASMNNMSFVLPSVALLQAYYLGINGVFMRDFQ
SKPPLRFNYTGDNIPKRLWAPELATKVRVVTYNSTVQLVYQSTNIFVAENHP
MHLHGYDFFVVGQGFGNYNPITDPIKFNLVDPPRRNTVIAPVSGWVAIRFKA
DNPGVWFL_HCHLDDHLAWGL_NMVFLVKNGRGPLATLEPPPADLPKC</u>

Figure 28: Amino Acid sequence of SeqID 295. The conserved multicopper oxidase, type 1, family domains are underlined and the multicopper oxidase, copper-binding site is in bold.

MSLRSLCPFSAWLVFLCSLIAYLAAI<u>PNAAIVNYTFTIEPKIVTRLCKNYTVVTV
NGQLPGPTIYVHDGDTVIVETYNKAEYNATLHWHGVEQLRTPWADGPAYVT
QCPIPPGGHYTYKFNITRQEGTVWWHAHYSWLRATVHGAFVMYPKEGSSY
PFTKPYAEIPIIGEWWNDNPIAVIDEAIRTGGQPNISDAYTINGQPGDLFNCS
TSGTFRLSVKSGQTYLLRIVNAALNSGHFFKIAGHKITVVAVDACYTKPYKTD
VLVISAGQTTDVLITANQPVGKYYMAARAYNNQAAGDFDNTTATAILEYIGAQ
NYTSPILPSLPAYNDTDTVTIFSRALRSLASQEHPVDVPQTIDESLISTVGLGL
LPCETGNTCEGPNGTRLSASMNNI<u>SFVDPTISLLQAYYYNISGVYMTDFPSK
PAVRFNYTGDDIPRKFWIPDPATKVKVLEYNSTVQLVFQSTNIFVAENHPMH
LHGYNFYLVGDGYGNYNPDTDQKKFNLVDPPLRNTVIAPVSGWVAIRFKAS
NPGMWFLHCHLDDHFTWGLNMVFLVKNGS</u>TPSSTIEPPPADLPAC

Figure 29: Amino Acid sequence of SeqID 296. The conserved multicopper oxidase, type 1, family domain is underlined and the multicopper oxidases signature 2 is in bold.

MMAPMAGAEYGIKLIIQLLVVLLAVQLVAGKTTR<u>HYSFHVRLKNVTRLCHTKP</u>
<u>LITVNGKSPGPKVVVREGDRVIIKVHNHVSNNVSIHWHGVRQLRSGWADGP</u>
<u>AYITQCPIQTGQTYVYNFTVTGQRGTLWWHAHISWLRASVYGAFIIYPKRHV</u>
<u>PYPFPKPYKEVPLILGEWWNADTEKVVNQAMQTGGGPNVSDCYTINGHPG</u>
<u>PLYNCSAINDTFILNVVPGKTYLLRIINAALNDELFLTIANHTMTVVEVDAVYTK</u>
<u>PVTTNTILITPGQTTNVLLTASASDYKGKQFFILASPYATGQGTFDNTTLAGIL</u>
<u>TYSKHVLFNTSHLNSSSNFTNALMPKLPVFNDTSFATNFTLKIKSLANAQYPA</u>
<u>LVPQTVDRKFYFTVSLGLNPCPKGQKCKGVNGTKFTASINNISFVMPTVALL</u>
<u>QSHYTGKMKGIYKTNFPDNPPFPFNYTGNPPKNVTTPMNGTRAKVIPFNTT</u>
<u>VQLVLQDTSIAGVESHPIHLHGFNFFVVGQGFGNYNETKDSPKFNLVDPAER</u>
<u>NTVGVPSGGVVALRFRADNPGVWFMHCHLEVHTSWGLKMAWIVKNGKGP</u>
SQSILPPPPDLPPC

Figure 30: Amino Acid sequence of SeqID 297. The conserved multicopper oxidase, type 1, family domain is underlined and the multicopper oxidases signature 2 is in bold.

MSSDANATSFLTFLLLLLLTIEITAAAASSDYSVK<u>RFDFHVQYQNVTRLCRTKS</u>
<u>LLTINGQFPGPTIAVNEGDSVEVKVHNDAKYNMTIHWHGVRQLGTGWSDGP</u>
<u>AYITQCPIQKGQSYTYKFKVDGQVGALFWHAHISWQRASIHGAFTIYPRKGV</u>
<u>PYPFPKPDAEAQILFGEWWNGDVEAIEAYANKYGGGPNVSDAYTINGQPGL</u>
<u>LFPCSAKDTFVQHVHHGKTYLLRIVNAALNVQLFFAIANHTMTVVEIDATYTK</u>
<u>PYTTNYILLAPGQTMSVIMATDQPNGKYIMAARPYVTSDVPFDNTTTTAILQY</u>
<u>AGSSRSSSENLQIMPNLPDMRDTDSATNFSATLRSLNSAQYPSIVPKKIDTR</u>
<u>LFFTVGLNLQDCPPGDSCKGYYGGRFSASVNNQSFILPQTALLQAAYNNNS</u>
<u>GVFSRDFPSRPPLQFNYTANNLSINMNPQFSTRVNCIPYNANVELILQDTGIM</u>
<u>GFENHPIHIHGYNFFVVGRGFGNYKPTTDPSSFNLVDPPIHNTVGVPKGGW</u>
<u>AALRFKADNPGVWFMHCHLEVHTSWGLAMAFLVEKEG</u>GLRQSLGPPPQDL
PPC

Figure 31: Amino Acid sequence of SeqID 298. The conserved multicopper oxidase, type 1, family domain is underlined,The multicopper oxidases signature 1 is in bold and the multicopper oxidases signature 2 is in bold/italics.

MMRISSATILALVVCLTFLTVTA<u>LATDILRHTFVIEAKPVTRLCKTHDIITVNGQ
FPGPTLHVRNGDTLVVKVYNRAQYNATIHWHGIRQFRTGWADGPEFITQCPI
RPGGSYTYRFTITEQEGTLWWHAHSSWLRASVYGALVIHPRLGTTYPFTMP
HRETPIILGEVWWNRNPIDVVNQATRTGAAPNISDAYTINGQPGDLYPCSTRD
TFRLPIYDDEIHLLRIVNAALNQELFFSVANHKLTVVAVDASYTKPFRTKYVML
GPGQTTDVILRAARHRVGTYYMAARAYSSAQGVPFDNTTTTAILEYRTRGLP
RPSSSGPVMPILPAYNDTRTATHFARGLRSLANIEHPVYVPQTVDENLFYTIG
LGLFNCPNQSCGGPNGTRFTASMNNISFVLPSTFSILQAHYLGRKGIFTTGF
PDNPPVQFDYTAQNVSRSLWSPVKGTKVKVLKYNAKVQIILQDTNIVNAENH
PIHLHGYDFYIVGEGFGNYNPRTDPQTFNLVDPPMRNTVAVPVNGWAAIRF
VADNPG**AWLM*HCHLDVHITWGL*AMVFLVENGPTYMTTIETPPPDLPVC</u>

Figure 32: Amino Acid sequence of SeqID 299. The conserved multicopper oxidase, type 1, family domain is underlined and the multicopper oxidases signature 2 is in bold.

MACFVNRTSFLCACAAFVLSLLAVIRYAQCAAPSRNSK<u>FFEFHVQYQNTTRL
CQSKPLLTVNGQFPGPTIAVNEGDNVIVKVTNHVKHNTTIHWHGVRQFRTG
WADGPAYITQCPIQERQSYTYRFKVSEQRGTLLWHAHISWQRASVHGAFIIY
PKQGVPYPFPKPDFEVSILLGEWWSGDPEAVEAETMRFGGGPNVSDAYTIN
GQPGLLYPCSDKDTFVQRVDGGKTYLLRLINAALNDELFFAIAKHNFTVVEA
DACYTKHYTTDCIMIGPGQTMSVLMKTDQPVGRYMMAARPYVTASVPFDET
TPTAILEYKLPAQSLQLPIILPDLPAMRDTYYATKFATALRSLNSREYPSNVPQ
KIDHHLFFAVSLNLQDCPVDSTCKGYFGGRFSASINNQSFVHPKTALLQAAY
YNISGVFSKDFPSRPPHEYNYTAPISAAQNMNPNFSTRVAVIPYNANVELILQ
GTSIMGFENHPIHIHGFNVYVVGQGFGNYDPNTEPASFNLVDPPLRNTVAVP
TSGWAALRFKADNPGIWYMHCHLEIHTTWGL</u>SMAFLVENGTGLAQSVLPPP
PDLPPC

Figure 33: Amino Acid sequence of SeqID 300. The conserved multicopper oxidase, type 1, family domains are underlined and the multicopper oxidases signature 2 is in bold.

MVISKYAAAMSCLLIAVVALEV<u>GAETRHYKFDIKFKNVTRLCHTKPIVTANGK
FPGPTIYAREGDTVTVKVTNHVTYNVSIHWHGIRQLRTGWADGPAYITQCPI
QTGQTYVYNFTITGQRGTLFWHAHILWLRATLYGPIVILPPKGVPYPFPKPDK
EVILILGEWWNSDTETVINQAMNSGLAPNSSDSHTINGKAGPLFYCPTKDTF
ALSVEPDKTYLLRIINAALNQEVFFDVANHHLTVVEVDAVYTKPFETKAIVIAP
GQTTNALLHTDKKAGRYFMAARVFMDAPITVDNKTATAILQYTGSSNSLNPV
LPLIPALNDTAFSSNFSNALKSLNSPQYPAKVPQSIDRNLFFTVGLALNSCPT
CINGSRPAASVNNITFTMPTVALLQSHYFNISGVFTTDFPDNPPATFNYTGTP
PKNLQSSNGTRLSRIPFNSTVQLVLQDTSMLTVENHPVHLHGFNFFIVGRGF
GNYDPKKDPAKFNLVDPPERNTVGVPTGGWTVIRFRADNPGVWFM**HCHLE
VHTTWGLKMAFLVENGH**GPEQSILPPPKDLPQC</u>

Figure 34: Amino Acid sequence of SeqID 301. The conserved multicopper oxidase, type 1, family domain is underlined and the multicopper oxidases signature 2 is in bold.

MGVSVMHIMLIAMVFLFYLAMEAEGKTRHYKFDVELKNVSRLCNTKPIVTVN
GEFPGPTIYAREGDTVIVKVTNHVKYNVSIHWHGVRQLRTGWADGPAYITQ
CPIQTGQSYAYNFTITGQRGTLVWHAHILWLRATIHGAIVILPPKHNPYPFPK
PHKEITVLLGEWWNADVEAVINEALKSGGAPNVSDAHTINGKPGPLFKCPTK
DTFVVPVEHGKTYLLRIINAALNDELFFDVANHHLKVVEVDAVYTKPLETNSIV
IAPGQTTNALLYANKKSGRYFMAARSFMDAPVAVDNKTATAILQYVNSNSST
DFVVMPSIPSQNDTSFATNFSNNLRSLNSARFPAKIPQTVDRHLFFTVGLAL
DSCPTCNNGSRVSASINNVSFVMPKISLLQAHFFNITGVFTTDFPDRPPTPFN
YTGTPPKNPMTKGTRLARIPFNSTVQLVLQGTSVLTVENHPVHLHGFNFFI
VGRGFGNYDPKKDPAEFNLVDPPERNTVGVPTGGWTAIRFRADNPGVWFM
HCHLEVHTTWGLKMAFVVENGDGPNQSILPPPKDLPKC

Figure 35: Amino Acid sequence of SeqID 302. The conserved multicopper oxidase, type 1, family domains are underlined and the multicopper oxidases signature 2 is in bold.

MLNSKTLLCLCPCPCPSRAAVKYLLIVILLVIIQYLDIASGKHW<u>QTTRHYKFNV
RQSNVTRLCNTKPLITVNGQYPGPTIFAQEGDQVIIKLVNHVKDNVTIHWHGI
RQLRSGWADGPGYITQCPLQTGMSYVYNFTITRQRGTLWWHAHISWLRAS
VHGAIIIYPKPHVPYPFPKPYKEVPIILGEWWNADTEKVIQQALQSGGGPNVS
DAYTINGLPGPLYNCSNDTFVLNVNPGKTYLLRIINAALNDELFLAIANHSMTV
VEVDAVYVKPFQTDTLVITPGQTTNVLFTANATVNVGGVNQFYIAARPFATG
GGTFDNSTVAGIVSYNISNSNTSSTIMMPKLPALNDTSFAANFSAKLRSLATS
QFPALIPQTVDKKLFFTIGLGLNPCPKGMGNATCQAPNGTRFTASVNNI</u>**SFVL
PNTALLQSHYFKQMKGVYKTNFPDNPPFPFNYTGTPPNNTQAVNGTRVKVL
PFNATVQLILQDTSIFSTDSHPVHLHGFNFFVVGQGVGNYNESTDAPKFNLID
PVERNTVGVPKGGWAAIRFRADNPGVWFMHCHLEVHTSWGL**<u>KMAWVVKN
GK</u>GPLQTLPPPPSDLPPC

Figure 36: Amino Acid sequence of SeqID 303. The conserved multicopper oxidase, type 1, family domain is underlined,The multicopper oxidases signature 1 is in bold and the multicopper oxidases signature 2 is in bold/italics.

MAELGLNRPHVNKMRPISAKLIFLLVVCLNLFAATAMGSIH<u>RYTFDIESMSVT
RLCRTHNIITVNGQFPGPTLHVHSGDTLIVEVRNKAQYNATIHWHGIRQFRT
GWADGPEFVTQCPIRPGGSYIYKFKITGQEGTLVWHAHSSWLRATVYGALII
YPKRGTAYPYTVPDKQFPIVLGQWWNSNPIDVVNEATLTGAAPNISDAYTIN
GQPGDLYRDLYNCSTSDTTRIRVKAGETNLLRVINAAMNNDLFFAVANHSMT
VVAVDALYTKPVQTNFLMLGPGQTTDVLVTADQSIGSYYMAARAYSSGQGV
AFDNTTTTAILEYAGVNSTSSSPQMPDLPFFNDTKSMTQFNAALRSLASPQH
PVSVPHTVEENLLYTVGIGLFNGTRLGASMNNFSFVLPSTVSMLQAHYFGIK
GVFTENFPDNPPLQFDYTAQNISTSLWSPVKDTRVKVLKYNTTVQVVLQGT
NIVAGESHPIHLHGYDFYIVGTGFGNYNARRDPKHFNLVDPPKRNTVNVPVN
GWAAIRFVADNP**GVWMF*HCHLDVHVTWGL*AM**VFVVENGPDNGSSLQRPP
RDLPRCSEIEQQLILPNVDSSTTTS</u>

Figure 37: Amino Acid sequence of SeqID 304. The conserved multicopper oxidase, type 1, family domain is underlined,The multicopper oxidases signature 1 is in bold and the multicopper oxidases signature 2 is in bold/italics.

MDRILRQSSFNVLLLVLSFSLLQWIPCLCQPTTRTYDFKVQLKNITKLCNTTTI
ATVNGMFPGPTIYAQEDDTVIVKVTNLVSYNITLHWHGVKQKLSCWADGPR
FITQCPIKTGQNYTYKFTLTGQRGTLWWHAHIAWLRATVNGAIVIYPKTGVPY
PFQFPTEEHVLILGEWWGANVANLENAVMASGGGPPLSDAYLINGHPGPTY
NCSAQDVWTMPVVKGKTYLMRVINAALNIEHFFSVAKHKITVVATDAEYTKP
YTVDNIMIAPGNTYDILLRAYRGPNKDYYIGISPYLSANLTVNTGKSFAILSYQ
RNSSSSAPIIKPRFPKINDSAAVFTGMSLMKSLNSQAYPANVPQKVDRNLFF
ALELNLEACKRGQTCNAPNNTRFQASINNVTFQVPQTSILQAYYDNIQGVFS
TDFPDNPPSPFNYTGNIMSNLQSNFGTRVSVLKYNQSVQLVLQGTNLTSAE
NHPVHLHGHNFFVVGYGTGNYPGPSNFNLVDPPSRNIIGVPPNGWVAIRFIA
DNPGVWYL***HCHLEIHLTWGL*SMAFLTLNGNGPNQTLPPPPPDYPKC

Figure 38: Amino Acid sequence of SeqID 305. The conserved multicopper oxidase, type 1, family domains are underlined and the multicopper oxidases signature 2 is in bold.

MKIHLPAEEMVLSMAACRNIVVKTMLIAMFLLPGAV<u>QGETRHYKFNIQLKNVT
RICHTKPIVTVNGEFPGPTIEAREGDTLLIKVTNHVKYNVSIHWHGVRQLRTG
WADGPAYITQCPIQTGQTYIYNFTVTGQRGTLWWHAHILWLRATLYGAIVILP
PPNVPYPFEPKPHKEITLVLGEWWNADVEAVINEALQTGAAPNISDAHTING
KPGEIFKCPVKDTFTLPVEHGKVYLLRIVNAALNDELFFEVANHQVKVVEVDA
VYTKPFDTKAIVIAPGQTTNVLLEANKRSGSYFVAARPFMDAPVTVNNKTAT
AILHYIGRNSESDIPAVNPLMPRLPLLNDTAFATSFTSKLRSLNSVQFPAKVP
QTIDRNLFFAVGLATESCQTCNGGLRASASINNISFVMPSISLLDAHIFNISGV
FTADFPDRPPTPFNYTGTPPKNLITSKGTRLSRLPFNSTVQLVLQDTSVLTVE
NHPIHLHGFNFFIVGRGFGNYDPNTDPASFNLVDPPERNTVGVPTGGWTVI
RFRADNPGVWFMHCHLEVHTTWGLKMAFLVENGD</u>GPDQSILPPPSDFPKC

Figure 39: Amino Acid sequence of SeqID 306. The conserved cytochrome P450 family domain is underlined.

MDLGLRQWLLSESRVEFYVKLAAALFLAVLLASWGKGRKRRMPPGPFPLPII
GNLHMLGDLPHRALEKLSMKHGPLMSLRLGSVLTLVVSSPEVAREFLKTHD
QLFASKNPSAAAKLLSFNYADFGFSSYSPYWRHLRKICALELLSGRRLDSLR
FIREEEVSAMIRSIINSDGSRPLNINQTLASVATAIICRMAFGRNYSDQELKAF
NSMVRESFLLLGSFNIGDYIPYLDWIDLQGFNRRIKKLHETQNHLLEKVIEEH
VARNESNITHDLVDVLLAASADKDSEFQISRDSIKGVIFDVLLGGSDTAPTAIE
WAMSEALRNPPVMKKLQDELESVVGLGRMVCESDLPKLVYLQAAVKETLRL
HPSGPLLVRHLFGTASCNVLGYEIPQNTLVLVNVWAIGRNPKSWEDAEVFK
PERFMEKVGSEVDANGDQNFGCLLFGAGRRRCPGQQLGTLLVEFGLAQLL
HCFNWRLPLDDINGENQEVDMNEMFNGVTLRKARELSAIPTPRLECIAHLK

Figure 40: Amino Acid sequence of SeqID 307. The conserved cytochrome P450 family domain is underlined.

MGFDGNLVSDIVGITGGGLNAYYSLGLLALFGSWVLLLRIRPWSAKLL<u>PPGP
PALPIIGNLHMLGKLPHRNLRDIAQKYGPLMFLRFGSVPTVVASSPEMAEQF
LKTHDLNFAGRPSTTVGKNMIYNSTDIGFSPYGPYWRTVRKVCVLELLSPRR
LELLKFVREEEVSALLESVTKCCASGEAANVSKLVSTMTTDIICRMAFGKKYC
EEDLDSRGFKDMIKEVFFLSGAINIGDFIPWLEWLDLQGLRRRQKSCHNTFD
AFFEMVIEEHMEKSKGDSADNKDFVDVMLGLMDNNDMEIKITRDNIKAVIFD
MLGAGTDTSSATLEWAMSEMLLNPSMMRKVQEELESVVGLDRRVEEGDLP
RLPYLKAVVKETLRLHPPGPLLIPHESFNDCTVGGYFIPRKSRLIVNVWALAR
DPKSWEDADVFKPERFVGSPIDIKGQHFQMLPFGSGRRGCPGQPLALTVVE
YTLASLLHCFDWKLPAGMKPGDLDMTEEFGLSTPRSVHLVAVPTLRLKV</u>

Figure 41: Amino Acid sequence of SeqID 308. The conserved cytochrome P450 family domain is underlined.

MGFDGNLVSDIVGITGGGLNAYYSLGLLALFGSWVLLLRIRPRSAKLLPPGP
PALPIIGNLHMLGKLPHRNLRDIAQKYGPLMFLRFGSVPTVVASSPEMAEQF
LKTHDLNFAGRPSTTVGKNMIYNSTDIGFSPYGPYWRTVRKVCVLELLSPRR
LELLKFVREEEVSALLESVTKCCASGEAANVSKLVSTMTTDIICRMAFGKKYC
EEDLDSRGFKDMIKEVFFLSGAINIGDFIPWLEWLDLQGLRRRQKSCHNTFD
AFFEMAIEEHMEKSKGDSADNKDFVDVMLGLMDNNDMEIKITRDNIKAVIFD
MLGAGTDTSSATLEWAMSEMLLNPSMMRKVQEELESVVGLDRRVEEGDLP
RLPYLKAVVKETLRLHPPGPLLIPHESFNDCTVGGYFIPRKSRLIVNVWALAR
DPKSWEDADVFKPERFVGSPIDIKGQHFQMLPFGSGRRGCPGQPLALTVVE
YTLASLLHCFDWKLPAGMKPGDLDMTEEFGLSTPRSVHLVAVPTLRLKV

Figure 42: Amino Acid sequence of SeqID 309. The conserved cytochrome P450 family domain is underlined and the cytochrome P450 cysteine heme-iron ligand signature is in bold.

MSVPEMGPFGVVVSGIVAIAIVYKLVQRWRFKLPPGPRPWPVVGNLLQIEPV
RFRCFWDWSKKYGPIMSVWFGSTLNVVVSNTELAKEVLKEHDQQLADRPR
SRSAEKFSRNGQDLIWADYGPHYVKVRKVCTLELFSPKRLEALRPIREDEVA
AMVESIFNDCGKQEGIGKPLMVKKYLSGVAFNNITRLAFGKRFLNEEGKMDP
QGVEFKEIVATGLKLGASLTMAEHIPYLRWMFPLEEGAFAKHGARRDNVTK
AIMEEHTLARQTSGAKQHFVDALLTLQEKYDLSEDTIIGLLWDMITAGMDTTA
ITVEWAMAELVRNPRIQQKAQEEIDQVVGRDRVMNETDFPHLPYLQCITKEA
LRLHPPTPLMLPHKATQNVKIGGYDIPKGSNVHVNVWAIARDPAVWKDPVTF
RPERFLEEDVDIKGHDYRLLPFGAGRRICPGAQLGINLVQSMLGHLLHHFVW
APPEGMKAEDIDLTENPGLVTFMAKPVQAIAIPRLPDHLYKRQPLN

Figure 43: Amino Acid sequence of SeqID 310. The conserved cytochrome P450 family domain is underlined and the cytochrome P450 cysteine heme-iron ligand signature is in bold.

MDIGWVSWYSVLGITSAIVFLVLDLWRRRTYGRL<u>PPGPLGWPIVGNLLQLGN</u>
<u>NPNESLFHLATKYGPLMSVSLGMKTTVVVSSPAMAKEVLKTHDQLLAGRTVI</u>
<u>QSVKPASHDKYSFVWAQYGSHCRMLRRISNTELFNVKRLGTLQDLRRDQVL</u>
<u>LTIQRILQEGIEGKSINIEDAMVHFSVNLLGNMAFGKDMFDSHSPAFEEFKNSI</u>
<u>SNMMTSLGAPNLADYFPFLQRLDPQGVGHNTKICMERVFRILDKFMEDRLV</u>
<u>KRGKTMDGNDDAKDLLDVLLDMRSNEFTVIHIRSYLTDIFGAGIDTTAKTME</u>
<u>WAMAELIRNPEKMKRAQAELDQVVGRNRRVEESDTESLPYLCAVVKEVFRL</u>
<u>HPVGPLLLPHRAVTACEIGGYLIPKDTQVIVNVWAIGRDPSIWNEPSKFVPER</u>
<u>FMDSKMSSVDFKGQHFELLPFGSGRRMCVGLPLANRIIHLVLASLLHSFDW</u>
<u>APPKGMTAEHVDMTEKFGVVMQKAVPLETMPTPRLPPDLY</u>

Figure 44: Amino Acid sequence of SeqID 311. The conserved cytochrome P450 family domain is underlined and the cytochrome P450 cysteine heme-iron ligand signature is in bold.

MEEISGFWYYVMIFMTLWLVLKVINMSRKGAGKL<u>PPGPPGWPIVGNLLQLG
GKPNESMYHLAAKYGPLMTLQLGMRTTVVASSPAMAKEVLKNHDQILSGRT
VVEAAKCLSYSDTSLVWNNCGPRWRMLRKFCNIELFSVKRLEALQHLRRDQ
VFSTIRSIFEDSIKAKGVNLGHSAFLASLNLLGNLIFSQNIFGRDSQAAEEFKE
TVTKLMVIGGKPNLADYFPFLRILDPQGVSRDCSKNIAIVFELLDRSVEVRLQ
SRREGRTDDSSGKAKDFLDILLEYKSESGETFTKKDIIPFLYDMFVAGSETSS
ATIEWAMAEAIRNPRIMKKAQAELDEVIGTGRRVEETDIDRLPYLHAVVKETF
RLHPPAPLLIPHRAESSCEVAGYMIPKDTQLLVNAWAIGRDPTIWDEPTKFKP
ERFVESEMEYRGQNFELIPFGAGRRICPGLPLAHRMVHVVTASLLHSFNWS
LPDGITTDTMDMSERFGITLQRASPLIAI</u>PSLRLPSHLFNDQHH

Figure 45: Amino Acid sequence of SeqID 312. The conserved cytochrome P450 family domain is underlined.

MIMMEMTSVANIEKGLLVIFAVIVGSIFISKLKSKKFKLPPGPLAVPIFGNWLQV
GDDLNHKNLGDLAKKYGEIFLLKMGQRNLVVVSSPEVAKEVLHTQGVEFGS
RTRNVVLDIFTGKGQDMVFTVYGEHWRKMRRIMTVPFFTNKVVQQYRFAW
EDELGRAVDDIKKRPEASTTGIVIRRRLQLVMYNIMYRMMFDRRFQSEDDPL
FLRLKALNGERSRLSQSFDFNYGDFIPVLRPFLRGYLKICKEVKEKRLSLFKD
YFIDERKKLAASSRGSKVTGEKCGIDHIFEAEEKGEINEDNVLYIVENINVAAIE
TTLWSMEWGIAEIVNSPDIQQKIRAELDAVIGRAVPLTEPDITKLPYLQAVVKE
TMRLHMAIPLLVPHMNLDHAKLCGYDIPAESKILVNAWFLANNPEVWVDKPE
EFIPERFLGDQEKIEASGNDFRFLPFGVGRRSCPGIILALPIVALALGRLVQNF
ELLPPPGQSRVDVTEKRGQFSLQILNHSVVVAKPID

Figure 46: Amino Acid sequence of SeqID 313. The conserved cytochrome P450 family domain is underlined.

MEIMTVASLEKGLLAIFAVIVGAIFISKLKSKKLKLPPGPLAVPIFGNWLQVGD
DLNHRNLGDLAKKYGEIFLLKMGQRNLVVVSSPELAKEVLHTQGVEFGSRT
RNVVFDIFTGKGQDMVFTVYGEHWRKMRRIMTVPFFTNKVVQQYRFAWED
ELGRAVDDIKKRPDASTTGIVIRRRLQLVMYNIMYRMMFDRRFESEDDPLFL
RLKALNGERSRLAQSFDYNYGDFIPVLRPFLRGYLKICKEVKESRLSLFKDYF
IDERKKLASTTGSKVTGDKCAIDHIFEAQDKGEINEDNVLYIVENINVAAIETTL
WSMEWGLAEIVNHPEIQQKIRAELDAVIGRGVPLTEPDTTKLPYLQAVVKETL
RLHMAIPLLVPHMNLHQAKLGGYDIPAESKILVNAWFLANNPEWWEKPEEFI
PERFLGEEKIEASGNDFRFLPFGVGRRSCPGIILALPILALALGRLVQNFELLP
PPGQSKVDVTEKGGQFSLHILNHSVVVAKPIA

Figure 47: Amino Acid sequence of SeqID 314. The conserved cytochrome P450 family domain is underlined.

MEIMTVASLEKGLLAIFAVIVGAIFISKLKSKKLKLPPGPLAVPIFGNWLQVGD
DLNHRNLGDLAKKYGEIFLLKMGQRNLVVVSSPELAKEVLHTQGVEFGSRT
RNVVFDIFTGKGQDMVFTVYGEHWRKMRRIMTVPFFTNKVVQQYRFAWED
ELGRAVDDIKKRPEASTTGIVIRRRLRLVMYNIMYRMMFDRRFESEDDPLFL
RLKALNGERSRLAQSFDYNYGDFIPVLRPFLRGYLKICKEVKESRLSLFKDYF
IDERKKLASTTGSKVTGDKCAIDHIFEAQDKGEINEDNVLYIVENINVAAIETTL
WSMEWGLAEIVNHPEIQQKIRAELDAVIGRGVPLTEPDTTKLPYLQAVVKETL
RLHMAIPLLVPHMNLHQAKLGGYDIPAESKILVNAWFLANNPEWWEKPEEFI
PERFLGEEKIEASGNDFRFLPFGVGRRSCPGIILALPILALALGRLVQNFELLP
PPGQSKVDVTEKGGQFSLHILNHSVVVAKPIA

Figure 48: Amino Acid sequence of SeqID 315. The conserved cytochrome P450 family domain is underlined.

MGSEVLAQGSALLEKSLIALLVVVVVGAVLVNKLRGRKLKLPPGPFALPIFGN
WLQVGDDLNHRNLSDFAKKYGKIFLLKMGQRNLVVVSSPDLAKEVLHTQGV
EFGSRTRNVVFDIFTGKGQDMVFTVYGDHWRKMRRIMTVPFFTNKVVQHY
RFAWEDEISRVVADVKSRAESSTSGIVIRRRLQLMMYNIMYRMMFDRRFES
EDDPLFLKLKALNGERSRLAQSFEYNYGDFIPILRPFLRGYLRICNEIKEKRLS
LFKDYFVEERKKLNSTKTSTNTGELKCAMDHILDAQDKGEINEDNVLYIVENI
NVAAIETTLWSMEWGIAELVNHQDIQSKVRAELDAVLGPGVQITEPDTTRLP
YLQAVVKETLRLRMAIPLLVPHMNLHDAKLGGYDIPAESKILVNAWWLANNP
ANWKNPEEFRPERFFEEEKHTEANGNDFKFLPFGVGRRSCPGIILALPLLAL
SIGRLVQNFHLLPPAGQSKVDVTEKGGQFSLHILNHSLIVAKPIASA

Figure 49: Amino Acid sequence of SeqID 316. The conserved cytochrome P450 family domain is underlined.

MMDITMSACVLACCGLLFFLVKVAKILWWKPLQIQKHFESQGISG<u>PPCRLLY</u>
<u>GNMLDMLKMREQAISRPMELSHDIIPRALSFYSRWTETYGNTFIHWFGSTAR</u>
<u>LNITDPDLIWEVLCNKSGLYKKSVQMKQLNGEGLLSLEGEMWAQHRRIINPA</u>
<u>FHVEHLKGMVPMVIGSTSAMLDKWKERIESGENEIEVCKEFQNLTEDILAHT</u>
<u>VFGSSYSEGKRVFALQAEQTMLITEVPRSLLRALISRFLPTKKNRYMRKLDR</u>
<u>EIRGSLRQLIQSKKQTWSLGKSSSYGGDLISVMTSSSRDQQQQGVVLQKGM</u>
<u>MSIEEIVEECKTFFFAGHDTTLCLLAWAMILLAMHPQWQDRARKEILSICRHQ</u>
<u>APKPENLNQLKIMTMILNESLRLYPPVVALIRQAEQDMKLGNFSVPAGTQLLF</u>
<u>PIIALHHDPSLWGDNAKEFDPERFCDGVSKAAKHPMAFMPFGMGPRICVGQ</u>
<u>NFALLQSKLILAMILQRFSISLSPTYTHAPIPVVFLQPQFGAQIVMTPLSQE</u>

Figure 50: Amino Acid sequence of SeqID 317. The conserved cytochrome P450 family domain is underlined.

MSEQLIGAAMEKLDLQRGLLALFALIVAAIFVSKLKSKKLKLPPGPRAVPIFGN
WLQVGDDLNQINLTDLAKKYGDIFLLKMGQRNLLVVASPELAKEVLQTQGVE
FGSRPRNVVYDIFTGSGQDMIFTYYGHHWRKMRRIMTAPFFTHNVVQKYRS
AWEEEIGRAMEDIRARPEASSEGIVIRGRMQLMVYNIMYRMLFDRRFESEED
PLFLRLKTLNAQRSRMGQSFEYNYGDFIPILSPLLRGYMKICKQVKEKRQALF
TESFIKERRQLGITKGDRKCGMDYIFEAQEKGEINEENVLYLIDNMNTAGMET
IVWTMEWVIAELVNHPEIQQKIRDELDAVVGPGIPMTESDIVKLPYLQAVMKE
SLRLHITLPFVPRLNVPQTKLGGYDIPAGTKVLVNIWWLANNPELWDNPQDFI
PERFLQEGEKIEFHGNDFRFLPFGAGRRSCPGIHMALANVALTVGRLLQNFE
LLPPPGKSKVDVSDKGGQFSLPILNHTLLVAKPRLPASS

Figure 51: Amino Acid sequence of SeqID 318. The conserved O-methyltransferase domain of family 2 is underlined.

MDCKGNTSTEDNSSVEKMEGDEWQGRLAMMELANMLSVPMALNAVAELN
VADIIWQNGANTPLSASQILSQLQTQSPDSCSSAHNLQRIMRMMASYNVFKE
SVTEDSNGVRERLYSLTDVGKTLVKDETGLSYGSYVLQHHQKALMGAWPLL
HSAVLDPSEEPFRKANGKPAYEFYGDDEDSNELMRTAMASLSMPFMRTVL
KYYQGFKGVRTLVDVGGSSGLCLHMIIQKHGNIRGINFDLPYVVAGAPAYDG
IEHVGGDMFEFIPSGDAIFMKWILSGWGDEKCIQILRNCYKALPDGGKVIACE
PVLPKYTDDSQRTRTLLEGDIFIMTIYSSGGKERTEEEFRKLCSDAGFSKVET
RDLDPFYSLLEIQK

Figure 52: Amino Acid sequence of SeqID 319. The conserved O-methyltransferase domain of family 2 is underlined.

MDSNMNGLAKSNGCEISRDGFFESEEEELQGQAEAWKCTFAFAESLAVKC
VVLLGIPDMIAREGPRATLSLGEIVAKLPTESPDAACLFRIMRFLVAKGIFRAS
KSAREGGAFETRYGLTPASKWLVKGRELSMAPMLLMQNDETTLAPWHHFN
ECVLEGGVAFQKANGAEIWSYASDHPDFNNLFNNAMACNARIVMKAILSKY
QGFHSLNSLVDVGGGTGTAVAEIVRAYPFIRGINYDLPHVVATASSLSGVQH
VGGDMFETVPTGDAIFMKWIMHDWNDEDCIKILKNCRKAIPDTGKVIIVDVVL
DADQGDNTDKKRKKAVDPIVGTVFDLVMVAHSSGGKERSEKEWKRILLEGG
FSRYNIIEIPALQSVIEAFPR

Figure 53: Amino Acid sequence of SeqID 320. The conserved O-methyltransferase domain of family 2 is underlined.

MAADPMDSIDDVLALATVQHINSSRDPAATHQLQLYEMILSAVKPLALKAAVL
LNIPDIIATRGNGGPLSVEQIAFHIAAANSSSTSNSHVDVGYLHRILRFLASYG
VFTEEEEANQA<u>DGADLKKRKYGLTGISKLLAQGETQQSCGHFLHLIANNVYL</u>
<u>DAFQHLHDSVLEGCYTFNKAYGMSPWEYLGRDPQANQIFNNAMAANSSTV</u>
<u>MASVAKMYEDGFKSMATLVDVGGGIGTSLFIIVKEHSHIRGINLDLPHVIATAP</u>
<u>LITGVEHMEGNKFEHIPSADAVMMKWILHDWADEECVKLLRRSYDATPAKG</u>
<u>KVLIVEAVVEGDKEGESMSRRLGLLYDISMMVYTTGGKERTEEEFKGLFQR</u>
AGFKSHTIIKLPFLQSLIVLSKA

Figure 54: Amino Acid sequence of SeqID 321. The conserved O-methyltransferase domain of family 2 is underlined.

MAADPMDSIDDVLALATVQHINSSRDPAATHQLQLYEMILSAVKPLALKAAVL
LNIPDIIATRGNGGPLSVEQIAFHIAAANSSSTSNSHVDVGYLHRILRFLASYG
VFTEEEEANQA<u>DGADLKKRKYGLTGISKLLAQGETQQSCGHFLHLIANNVYL
DAFQHLHDSVLEGCYTFNKAYGMSPWEYLGRDPQANQIFNNAMAANSSTV
MASVAKMYEDGFKSMATLVDVGGCIGTSLFIIVKEHSHIRGINLDLPHVIATAP
LITGVEHMEGNMFEHIPSADAVMMKWILHDWADEECVKLLRRSYDATPAKG
KVLIVEAVVEGDKEGESMSRRLGLLYDISMMVYTTGGKERTEEEFKGLFQR
AGFKSHTIIKLPFLQSLIVLSKS</u>

Figure 55: Amino Acid sequence of SeqID 322. The conserved O-methyltransferase domain of family 2 is underlined.

MLTLVPPMDSIHHVLAPATGQHIDSSRESAATQELQLYEMIFSAVKPLALKAA
VLLNIPDIIATRGNGGPVSAEQIAFHIAAANSSSTGNSHLDVGYLYRILRFLAS
YGVFAEQEEADQADDADTKKIKFGLTGISKLLVHAGNEQSCGPFLLLIASNVY
LEAFQHLHESVLEGCYTFNKAHGMDPWEYLGNNPESNKIFNEAMATNTRSV
MASVAKMYEDGFMSMATLVDVGGGMGSALSIIVKEHPHIRGINLDLPHVIAT
APPITGVEHMEGNMFEHIPSADAVMMKWILHDWADEECVKLLRRSYDATPA
KGKVLIVEAVVEGDKEGESMSRRLGLLYDILMMVYTTGGKERTEEEFKGLFQ
RAGFKSHTIIKLPFLQSLIVLSKA

Figure 56: Amino Acid sequence of SeqID 323. The conserved O-methyltransferase domain of family 2 is underlined.

MLTLAPPMDSIHHVLVPVTGQHIDSSPESAATQELQLYEMIFSAVKPLALKAA
VLLNIPDIIATRGKEGPLSAEQIAFHIAAANSSSTSNSHVDVGYLYRILRFLASY
GVFSEQEEADQADDA<u>DTKKIKFGLTGISKLLVQGGNQQSCGPFLLLIANNVY
LEAFQHLHESVLEGCYTFNKAHGTSPWEYLGRNPQANQIFNEGVATNTRSV
MASVAKMYEDGFKSMATLVDVGGGMGSALSIIVKEHSHIRGINLDQPHVIAT
APPITGVEHMEGNMFEHIPSADAVMMKWIIHDWGDEECVKLLRRSYEATPA
KGKVLIVEAIVGGDKEGESMSRRLGLSYDMLLMVYTTGGKERTEEEFKRLF
QLAGFKSYTIIKLPFLQSLIVLSKA</u>

Figure 57: Amino Acid sequence of SeqID 324. The conserved O-methyltransferase domain of family 2 is underlined.

MGSGFEKSEMKSKIVNEDEWLLGMELGNFSCLPMAMKAAVELDVLQIIANA
GNGVQLSPTQIVGHIPTTNPDAAITLDRILRVLASHSVLSCSVTTNE<u>NGKAER
FYGLTPLCKYLVNNQDGVSLAPLVLMNQDKVLMESWFYLKDAVLEGSQPFT
KAHGMNAFEYPAIDQRFNKIFNRAMSENSTMLMNKILDTYEGFKEVQELVDV
GGGIGSTLNLIVSRYPHISGINFDLSHVLADAPHYPAVKHVGGDMFDSVPSG
QAIFMKWILHDWSDDHCRKLLKNCHKALPEKGKVIAVDTILPVAAETSPYAR
QGFHTDLLMLAYNPGGKERTEQEFQDLAK</u>ETGFAGGVEPVCCVNGMWVM
EFHK

Figure 58: Amino Acid sequence of SeqID 325. The conserved O-methyltransferase domain of family 2 is underlined.

MNMPSVKDEEALRASALSLAFSLENPFLLKGAIRLKIPDIISKAGPDVSLSVHQ
IAAQLPSEDPDMGALSRILTYLSTMGILQAIVPPEGVNAPMNIKYGLTNLTKTH
FTSEDISSRSLVPFVLLQTHPLYVTAWDHIDERVLHGGDNFKNSSGNGKDF
WNFAAGDPELNVIFNAGMVSVTKASITDVLAVYDGFKDINTLVDVGGGRGEA
LSLIIEAHPHIRAINFDLPHVIATAPTLPGVQHMTGNLFESAPSADAIFMKNFLH
SWNDEDCIKLLKNCHQALPDKGKLILSEAILDLTEGSDMIGSANVLDSLMLNC
LPGGGERTRKQWNDLLQAAGFSISKIVGRNGTLTKVIEAIKS

Figure 59: Amino Acid sequence of SeqID 326. The conserved O-methyltransferase domain of family 2 is underlined.

MGESSPATHCATMGESSPATHCATMGESSPATHCATMGESSSLFSATSAA
ASAPDAALQIDTSSSPRLQLYDMIFSLVKPLALKAAVNLNIPDIIATHGGGEGS
SLSVEDIASHIAASAPCNMNMKAPHLEYLFRLLRYLASYNVFTETSHAGGAA
EFKRYRYGLTALSELLTVQNEYSCVPLVFSATSKVPWEGLQRLHETVMEGC
PAFTKAFGMNAWDYFRTYPQENEIFNRALATDTRAVMASVVKVYDDGFKNI
NTVVDVAGGTGSAISMIVEAHPHIRGINLDLPHVIDTAPALPGVEHVRGNMFE
HIPRADAVFLKCVLHNWKDEQCVEILKTCHEATPGNGKVIIVDAIIEEEVGCV
QQMGLRSDIEMMAFTDGGRERTEDEFKKIFHLAGYRRYVITKLPSSPFSIIEIF
KA

Figure 60: Amino Acid sequence of SeqID 327. The conserved O-methyltransferase domain of family 2 is underlined.

MKGMAMEAHEDVKLLECSGMDILEVNEEASLQASALRMAFSIANPFLLKCAL
SLKIPDIIWRAGPDSPLSVQQIASQLPSEAPDMDALSGILTCLSAMGILKAIKP
TKDAQEINGAAEAMTMKYTLTDLTKTYFVSEDISPLSLAPLALMPTHALLMQP
WDHIHERVLHVGDNFKNSSGHGKEFWSYVAAEPEVNNVFNAAMLSLTKVE
MREILTYDGFKDVNTLVDLGGGHGQVMSQIISLYPHIHAINFDVPHVIATAPTL
HGITHISGDMFESVPSGDAILMKHVLHLWDDEDCIKLLKMCYKATSDKGKLII
VDAVLDTTEDSDPIGSGQLMDIVMLTVFPGARERTREQWNGILQSAGFSLSK
IVGKKGSLAKIIEALKC

Figure 61: Amino Acid sequence of SeqID 328. The conserved O-methyltransferase domain of family 2 is underlined.

MDRKEYNVQAPPPPPMDLIFSFAPALALKSAVLLKIPDIIATAGPDPDSSLSLR
QIAARLPTQTPHLDYLSRILRYLSTLGIFIESQTSSDPL<u>DFHYGLTHTAKCYFL
SDHNENKPCSMVPLLLMQTHEKLMAPWHHFHECVLQGEGCEGAFTKAHG
KDVWAYCMDDPDLNTVINNAMASFTNIVMIPFLSVYEGFKSGEKLTVVDVGG
GKGPAIAQIVKAYPHINGINFDLPHVIATAPPISDVQHVGGDMFHSVPSGDVIF
MKQILHDWDDERCAKILENCHRALPENGRLVVVEIVVSQDEQNRSQHVEMV
ASLTMLAHTNGRERNEQQWRRLFE</u>SSGFSTLKMVGLLGNTHFSVLEATKAK
IH

Figure 62: Amino Acid sequence of SeqID 329. The conserved O-methyltransferase domain of family 2 is underlined.

MVMGSSXSEEEELLGQAQAWRSTFAFAESLAVKSAVLLGIPDLIARQGPHG
TLSLREIVARLPRETPDASCLFRIMRFLAAKGVFRASVDSD<u>GGNESTRYGLT
PASKWLVQESRELSMAPMLLMQNDERSVAPWHRFNECVLDGGVAFERAN
GAEVWDYASAHPEFNDLFNSAMACNARIVMKAILSKYQGFHGLNSLVDVGG
GTGSAVAEIVRSYPSIKCINYDLPHVVATAPHHPGVEHQGGDMFKTVPLAEA
ILMKWIMHDWSDEECIKILKKCREAIPETGKVIIVDVVLDASDQDEKRKAVMD
PTIGIAFDLVMVAHSSGGRERREEEWKKILL</u>EGGFSRYNIITIPALQSVIEAFP
R

Figure 63: Amino Acid sequence of SeqID 331. The conserved O-methyltransferase domain of family 2 is underlined.

MASRAVQQTEVKAETTQTEEPTKVARHQEVGHKSLLQSDALYQYI<u>LETSVY
PREPAPLKELREVTAKHPWNLMTTSADEGQFLGLLLKLINAKNTMEIGVYTG
YSLLSTALALPDDGKILAMDINRENYDIGLPIIEKAGVAHKIDFREGPALPLLDE
MLQKEEMHGSFDFVFVDADKDNYLNYHKRLIDLVKVGGVIAYDNTLWNGSV
VAPPDAPLRKYVRYYRDFVVELNKALAADPRIEISQIPVGDGVTLCRRLH</u>

Figure 64: Amino Acid sequence of SeqID 332. The conserved O-methyltransferase domain of family 2 is underlined.

MAGTSVAAAEVKAQTTQAEEPVKVVRHQEVGHKSLLQSDALYQYI<u>LETSVY
PREPEPMKELREVTAKHPWNLMTTSADEGQFLGLLLKLINAKNTMEIGVYTG
YSLLSTALALPDDGKILAMDINRENYDIGLPIIEKAGVAHKIDFREGPALPVLDE
LLKNEDMHGSFDFVFVDADKDNYLNYHKRLIDLVKVGGLIAYDNTLWNGSVV
APPDAPLRKYVRYYRDFVMELNKALAVDPRIEISQIPVGDGVTLCRRVY</u>

Figure 65: Amino Acid sequence of SeqID 333. The conserved O-methyltransferase domain of family 2 is underlined.

MGSHAENGNGVEVVDPTDLTDIENGKPGYDKRTLPADWKFGVKLQNVMEE
SIYKYML<u>ETFTRHREDEASKELWERTWNLTQRGEMMTLPDQVQFLRLMVK
MSGAKKALEIGVFTGYSLLNIALALPSDGKVVAVDPGDDPKFGWPCFVKAG
VADKVEIKKTTGLDYLDSLIQKGEKDCFDFAFVDADKVNYVNYHPRLMKLVR
VGGVIIYDDTLWFGLVGGKDPHNLLKNDYMRTSLEGIKAINSMVANDPNLEV
ATVFMGYGVTVCYRT</u>A

Figure 66: Amino Acid sequence of SeqID 335. The conserved O-methyltransferase domain of family 2 is underlined.

MDHKSLLQSDALYQYI<u>LETSVYPREPEPLKELRELTSKHPRHVIAIPPGEGQF
LGLLLKLMNAKNTIEIGVYTGYSLLSTALALPSDGKIIAMDINRANYDMGLPIIE
KSGVAHKIDFREVPALPLLDEMLKNEEMHGSFDFAFVDADKDNYLNYHMRLI
DLVKVGGLIVYDNTLWQGSVALPPEVAISEGMSYGEDREHMLELNRALAAD
PRIEIAQIPIADGVTLCRRL</u>S

Figure 67: Amino Acid sequence of SeqID 336. The conserved O-methyltransferase domain of family 2 is underlined.

MEYKTLLQSDALYEYILETSVYPREPEPLKELRELTIKHPWHGMAIPPDEGQF
LGLLLKLMNAKNTIEIGVYTGYSLLSTALALPSDGKIIAMDINRANYDMGLPIIE
KAGVAHKIDFREVPALPLLDEMLKNEEMHGSFDFAFVDADKGNYLNYHMRLI
ALVKVGGLIAYDNTLWQGSVALPPEVAMSEGMNYGEDREHMLELNRALAA
DLRIEIAQIPIADGVTLCRRLS

Figure 68: Amino Acid sequence of SeqID 337. The conserved O-methyltransferase domain of family 2 is underlined.

MAQQCSGREEIPGTTDVQADSTQAQDEGNVAHYHTMGHKSLLQSDALYQY
ILETSVYPREPEPLKKLREVTAKVPGNVMAIPPDEAQFLGLLLKLMNAKNTIEI
GVFTGHSLLSTAVALPDDGKIIAMDPDRATYEMGRPIIEKAGVAHKIDFKEGP
ALPFLDEMVKNVGMHGSFDFAFVDADKGNYLNYHERLIDLVKIGGVIAYDNT
LWEGSVAAPPTDDMDEGFRNMRIFILEVNKVLAADPRIEIAQIPVADGITLCR
RLS

Figure 69: Amino Acid sequence of SeqID 339. The conserved O-methyltransferase domain of family 2 is underlined.

MTGLLCGGRNPNALSAICLHPASSAKPLPLNPPLISIWRYSKTKAVGVKLGC
YGVSSRRHVSTDRKGVVISSDDKYGNKQVVSLTPQLYHYILAN<u>VREPQILRE
LREETSTMAGSQMQVSPDQAQLLAMLVQTLGAKWCIEVGVYTGYSSLAVAL
VLPESGRLVACERDENCLAVAKRYYQRAGVSHKVDVRHGFGIDTLQDLLQN
GEANRYDFAFLDAEKRMYFDYYELLLQLIRPGGLIVIDNVLWHGRVADPLIND
KKTISLRDFNKVVFNDERVNISMVPIGDGMTLCRKK</u>

Figure_70: Amino Acid sequence of SeqID 340. The conserved haem peroxidase family domain is underlined. The peroxidases active site signature and the peroxidases proximal heme-ligand signature are in bold.

MTKYVIVSSIVCFFVFVSACIISVNGLVVHEDDLSKPVHGLSWTFYKDSCPDL
EAIVKSVLEPALDEDITQAAGLLRLHFHDCFVQGCDGSVLLTGTKRNPSEQQ
AQPNLTLRARALQLIDEIKTAVEASCSGVVTCADILALAARESVAQAGGPKFP
VPLGRRDSLKFASQSVVLANIPAPTLNLTQLMNIFGSKGFSLA**DLVALSGGH
T**IGIGHCNSFDNRLYNKATGKKIVDPSIANSLADDLYSLCPTVNNTVDFTNLDI
QTPNAFDKKYYANVQKNQVLFTSDQSLYTETDSAEIVDSFASSQTVFFKKFV
HGMHKMGQLDVLTGKKGEIRTTCSVPNPTSSAFEEVIEPVTHSEL

Figure 71: Amino Acid sequence of SeqID 341. The conserved haem peroxidase family domain is in bold. The peroxidases active site signature and the peroxidases proximal heme-ligand signature are in bold/italics. The plant ascorbate peroxidase domain is underlined.

MYKRYPTVSEE<u>YQKSVEKC**KRKLRGLIAEKKC*APIMLRLAWHS*AGTYDFK**</u>
<u>TKTGGPFGTIRHPDEIAHNANNGLDIAIRLLEPIKEQFPMISYADFYQLAGVV</u>
<u>AVEITGGPDIPFHPGRPDKTEPPEEGRLPDATKGVDHLRDVFGHMGLSDK</u>
<u>***DIVALSGGHTL*GRCHKERSGFEGAWTSNPLIFDNSYFKELLSGEKEGLLQL**</u>
<u>PSDKALLEDPIFRSYVEKYAADEDAFFADYAEAHLKLSELGF</u>AEEE

Figure 72: Amino Acid sequence of SeqID 342. The conserved haem peroxidase family domain is underlined. The peroxidases active site signature and the peroxidases proximal heme-ligand signature are in bold.

MAKLMIFCLLCTLCIAYAIRDNVLTLNADPPLVNGLSWTFYQKSCPQLESI<u>VK</u>
<u>KRIDFYLKQDITQAAGLLRLHFHDCFVQGCDGSVLLDGSASGPSEQGASPN</u>
<u>LSLRKKAFEIINDIKSRVDKACSVVVSCADVTALAAKESVRAAGGPQYRVPL</u>
<u>GRRDSLKFATQNVTVANLPAPFFKVTALINAFASKNLNVTDLVALSGGHTIG</u>
<u>MGHCTSFTDRLYPTQDTSLNKSFAQRLYTKCPSKTSTNTTVLDIRTPNVFDN</u>
<u>KYYVDLMNREGLFTSDQDLYTDSRTKAIVKEFALN</u>QDLFFQNFAVAMVKMS
QLNVLTGSKGEIRHNCSASNLASTIEVAVEDVIESYASFM

Figure 73: Amino Acid sequence of SeqID 343. The conserved haem peroxidase family domain is underlined. The peroxidases active site signature and the peroxidases proximal heme-ligand signature are in bold.

MPMGPVVDAAYLKSIDKARRDLRALIAEKNCAPIMLRLAWHDAGTYDAKTK
TGGANGSIRNEEELNHSANNGLKIALALCEPIKGKYPNITYADLYQLAGVVAV
EVTGGPTIEFVPGRKDSLASPREGRLPDAKKGSQHLRDIFYRMGLSDK**DIVA
LSGAHTL**GKAHPERSGFDGAWTEQPLKFDNSYFVELLKGESEGLLQLPTDK
CLVEDPSFRPYVDLYAKDEDAFFKDYAESHKKLSELGFRDPSSLPSGSGSE
VSTSTVLAQGAVGVVVAAAVVIFGYLYEAKRKSK

Figure 74: Amino Acid sequence of SeqID 344. The conserved haem peroxidase family domain is underlined and the peroxidases active site signature is in bold.

MAGTSGLRLQFRPVLITGLALMLWIQAIHAQSSNGLTPNYYDKSCPEALSI<u>IK</u>
<u>SGIEDAVKQEARFAASLLRLHFHDCFVKGCDASILLDDTANFTGEKTAKPNL</u>
<u>NSVRGFGVVDKIKSALEKKCPGVVSCADLLAVAARDSVVISGGPTWEALLG</u>
<u>RRDSRSASKSGANYNIPAPTSTHQTLETKFKLKGLHSLDLVVLSGGHTIGLS</u>
<u>RCTSFKARLYNNSGTAKPDPTLDTTYLKQLRIECPQNGTDDNQTVPLDPVTP</u>
<u>FKFDVNYYKNIVASKGLLNSDEILYSTNGSKTAAYVKFYTTHT</u>QAFFKQFAIS
MIKMGNLSPLTGSQGEIRKNCRKMN

Figure 75: Amino Acid sequence of SeqID 345. The conserved haem peroxidase family domain is underlined and the peroxidases proximal heme-ligand signature are in bold.

MGSKKSARKPLELAGFVIWVLLGLCVSNGSAQLSENFYAKICPNVESI<u>VRNV
VSQKFTQTFVTVPGTLRLFFHDCFVEGCDASVIIQSTSNNTAEKDFSDNLSLA
GDGFDTVIKAKQAVEKVCPNSVSCADILTMAARDVVALAGGPQFNVELGRR
DGLISQASRVNGNLPKASFTLNQLNFLFARKGLSQTDMVALSGAHTLGFSH
CNQFANRIYSFSASTPVDPSLNASYATQLQQMCPKNVDPTIAINIDPITPRKF
DNVYYQNLQSGKGLFSSDEVLYTDLRTRNSVNKFAQS</u>SDTFNTAFVSAMRN
LGRVDVKTGFQGEIRQDCSRFN

Figure 76: Amino Acid sequence of SeqID 346. The conserved haem peroxidase family domain is underlined and the peroxidases proximal heme-ligand signature are in bold.

MAFRYVSLNVIFLAFAFIQGTTAQLCPTFYQNTCPNVTNI<u>VGQVIQQALQNDS
RIAASLLRMHFHDCFVNGCDGSVLLDDTANFTGEKTAGPNNNSLRGFDVVD
NIKAAVESACNATVSCADILAIAAERSVVLSSGPSWTIHLGRRDSTTANATLP
NTAIPAPTDNVSTIIAKFQNVGLSVTDVVALSGGHTIGRARCTVFVNRLYNFS
GTGNPDPTLNSSYLSTLQSTCPQNGNGSTLTSLDPCTPNTFDNNYYINLQN
EMGLLQSDQELLNTTGAATISIVNDYTRS</u>QADFFSNFSNSMINMGNINPLTGT
SGEIRLNCRKVNG

Figure 77: Amino Acid sequence of SeqID 347. The conserved haem peroxidase family domain is underlined. The peroxidases active site signature and the peroxidases proximal heme-ligand signature are in bold.

MRSLVCISVMVFLCAINNAAHGQLSPTFYAKSCPTALSIVNAAVKKAVASEKR
MGASLLRLHFHDCFVQGCDGSILLDDNSTFTGEKTAGANANSVRGFDVVDT
IKTNLEAACSGVVSCADILAIAARDSVVALGGRSYTVQLGRRDSTTASLSSAN
SNLPSPASSLSTLMTAFQKQGLSTKDLVALSGAHTIGQARCTTFRTRIYNDT
NINAAFATSAKANCPSTGGDNTLSPLDVLTPTTFDNKYYTNLKSQKGLFHSD
QELFNGGSTDSRVSIYSTSQAIFFTDFAAAMVNMGNISPLTGTNGEIRTNCR
KVN

Figure 78: Amino Acid sequence of SeqID 348. The conserved haem peroxidase family domain is underlined and the peroxidases proximal heme-ligand signature is in bold.

MMIGIGKGSTALGFMVVVATLCELVPVNTQGTVVGFYKQTCPNVERL<u>VQLR</u>
<u>VQKKFSTDKTIVPALLRMHFHDCFVKGCDASLLVDSTAANQAEKEAGPNQT</u>
<u>VRGFEFIDEIKKVMEAVCANTVSCADIIALATRDAVALAGGPRYDVPTGRRD</u>
<u>GTVSKVDDANKLPDPNDSAIQSSSAFASKGLSVLDLVTLLGAHTVGITHCSF</u>
<u>FNDRLYNFLGTGKPDPTMDPALVTKLKTTCPDPASGSSADPPINLDQGTPSV</u>
<u>FDNSFYKQIAARRGILQIDQQLFEDASTTNFVRSFAGS</u>SPKPLNFSQQFVQSI
VKMGKLGVLTGNQGTIRKNCRVVNT

Figure 79: Amino Acid sequence of SeqID 349. The conserved haem peroxidase family domain is underlined. The peroxidases active site signature and the peroxidases proximal heme-ligand signature are in bold.

MARMKHIPGLTLQFQSVLITGAALFLWIQTSDAQDCNGLSHHYYQKSCPNA
QAIIKSVVSDAVKKEARMAASLLRLHFHDCFVQGCDASILLDDTASFTGEKT
ALPNRNSVRGFEVVDKIKSKLEEACPGVVSCADILAVAARDSVGFSVGPYW
EVLLGRRDSKTASKSGANNDIPAPNSTHQTLETKFNLKGLNVLDLVALSGSH
TIGLARCTSFKARLYNQTVNGKPDPTLNTSYLKRLRAVCPQTGTDDNRTTPL
DPVTPIKFDINYYRNLVEGTGLLRSDEILYSTKGSRTASLVRLYSTNTHAFFK
QFAASMIKMGNISPLTGSSGEIRKNCRKRN

Figure 80: Amino Acid sequence of SeqID 350. The conserved haem peroxidase family domain is underlined and the peroxidases active site signature is in bold.

MTSFTAMASVVCIALLFFSTVAFAQLNSTYYDTSCPKLLAT<u>VKAAVKTAVANE
KRMGASLLRLHFHDCFVNGCDGSVLLDDSSSLTGEKTALPNNNSLRGFDVI
DTIKSQVEAVCSGIVSCADILAITARDSVVELGGPTWTVLLGRRDSATASLSA
ANTNIPAPTSNLSGLISSFQAQGLSTKDMIVLSGAHTIGQARCTVFRIHIYNES
NINAAFATSLKTNCPSTGGDNNLSPLDLLTPTTFDNKYYTNLKSQKGLLHSD
QQLFNGGSADSQVTTYSTT</u>QSTFFTDFAASMLNMGNISPLTGTSGQIRKNC
RKPN

Figure 81: Amino Acid sequence of SeqID 351. The conserved haem peroxidase family domain is underlined. The peroxidases active site signature and the peroxidases proximal heme-ligand signature are in bold.

MKTFLFIALCVLCISSINNVAHGQLTSTFYSKVCPTALSI<u>VKAAVTKAVNNEKR</u>
<u>MGASLLRLHFHDCVNGCDGSILLDDNSTFTGEKTAGPNANSVRGFDVIDTI</u>
<u>KTQVEAACSGVVSCADILAIAARDSVVQLGGPTWTVLLGRRDSTTASLSAAN</u>
<u>NNIPSPASNLSALISSFTAHGLSTKDLVALSGAHTIGQARCTTFRARVYNESN</u>
<u>IDTSFATSVKANCPSAGGDNTLSPLDLATPTTFDNKYYPDLRSQKGLLHSDQ</u>
<u>QLFSGGSTNSQVTTYSSN</u>QNTFFTDFTAAMVKMGNISPLTGTNGQIRKNCR
KAN

Figure 82: Amino Acid sequence of SeqID 352. The conserved haem peroxidase family domain is underlined.

MTMHSSSSNSNGSLWMVVMVLTVTAQLVLAQQQQLLSVDYYNSSCPQLES
IIFKVMVRKQRANPTTAAGTLRIFFHDCFVEGCDASVLVSSMGAGHKAERDA
DINLSLPGDGFDAVARAKTAVEAQCPGVVSCADILTIATRDLITLVGGPKYQV
KKGRKDGLVSEASRVAGNLPEATMSVDELNALFESKGFNQSEMTTLSGAHT
VGFSHCKEFMGRIYKEPMDPTIDPQYAAGLQKVCPQQNLDPNMAAFNDVLS
PRTFDNVFYQNLPKGLGLLASDQILYTDARTIGLVETYASDQNAFFRDFALA
MDKLGSVGVKTGYEGEIRKSCDAFNKHS

Figure 83: Amino Acid sequence of SeqID 353. The conserved haem peroxidase family domain is underlined. The peroxidases active site signature and the peroxidases proximal heme-ligand signature are in bold.

MIMKTLLCTGVMAVFICFINTNAVNGQLRSTFYDKSCPRLQSI<u>VKSVVKQAVA
KEKRMGASLVRLHFHDCFVNGCDGSILLDDNATFTGEKTAGPNANSARGF
DVIDSIKTQVEAACSGVVSCADILTIAARDSIVQLQGPRWPVMLGRRDSTTAS
LSAANNKIPSPASSLSSLISSFQGHGLSTKDLVALSGAHTIGQSRCAFFRTRI
YNETNINAAFATSVKTNCPSVGGDNTLSPLDVVTPTTFDNKYHSNLKIQKGLL
HSDQQLFNGGSTDSQVTSYSTN</u>QNIFFRDFATAMVKMGNISPLTGTNGQIR
KNCRKSN

Figure 84: Amino Acid sequence of SeqID 354. The conserved haem peroxidase family domain is underlined. The peroxidases active site signature and the peroxidases proximal heme-ligand signature are in bold.

MMMRTLVYIGVMAVFVSFININAVNGQLSSTFYDKSCPSLQSIVKSVVKQAV
VKEKRMGASLVRLHFHDCFVNGCDGSILLDDNSTFTGEKTAGPNANSARGF
EVIDSIKTQVETACSGVVSCADILTIAARDSIVELEGPTWTVMLGRRDSPTAS
LSAANNNIPSPASSLSTLISSFQAHGLSTKDLVALSGAHTIGQSRCAFFRTRI
YNESNINAAFATSMKANCPSAGGDNTLSPLDVATPTTFDNKYYANLKIQKGL
LHSDQQLFNGGSTDSQVTAYSTNQNSFFTDFAAAMVKMGNISPLTGTSGQI
RKNCRKSN

Figure 85: Amino Acid sequence of SeqID 355. The conserved haem peroxidase family domain is underlined.

MGTTRFGIIELGVVISIGLVLGSNLSEGNLQTGFYSSSCPTAESV<u>VRSTVQQS
VQADPTLAAGLLRLHYHDCFVQGCDGSILITGPNAEQTAPGHSGLRGFDVIE
NAKKQLERICPRVVSCADIVALAARDAVALSNGPNYDVPTGRRDGMRSFAG
DASNMPDPTDSVDVLKRKFAAKGLSASDLVVLNGAHTIGTTACFFIEDRLYD
FAGAGDADPSMNPGYLTELRSICPQGGDVNARVALDRGSEFQFDNEFLEN
VREGNGALQSDASMYQDSSTRGYIDSYFGL</u>LGGLLGPSFESDFADAIVKMG
QVDVKTGSNGKIRSVCSVL

Figure 86: Amino Acid sequence of SeqID 356. The conserved haem peroxidase family domain is underlined. The peroxidases active site signature and the peroxidases proximal heme-ligand signature are in bold.

MEAQYFSAMFLLVIVSSAGAYASDLPTPVEGLSWTFYNDSCPTLQSIVQSTL
QPLLEQNITEAPGLLRLLFHDCFVQGCDASILLNGTASDPSEQQATPNLTLR
AAAFEIINKIKEAVEAKCSGVVSCADILALTASYAVSMGGGPEFLVPLGRRDS
LTFANQTVTLASLPSPTSNVTVLMTIFTEKGFNNFTELVALSGAHTFGISHCS
SFVNRLYPTQDTTLNAAFARELEHTCPTNTTVNTTNLDIRTPNVFDIKYYIDLQ
NGEALLTSDEDLYNDTRTRQIVNGFALNQTSFFNQFALSMLKMVQLDVLTGA
EGEIRKNCAVRNTNTSSYSIIDPAMGLSSSFSS

Figure 87: Amino Acid sequence of SeqID 357. The conserved haem peroxidase family domain is underlined and the peroxidases active site signature is in bold.

MASFTAMRSLAFIALLMCSTVAYAQLSATFYNTSCPKLLST<u>VQAAVKQAVAN
EKRMGASLLRLHFHDCFVNGCDGSVLLDDSSTLTGEKTAVPNNNSARGFD
VIDTIKSQVEAVCSGVVSCADILAIAARDSVVQLGGPTWTVQLGRRDSRTAS
LSGANNNIPAPTSNLSALISLFQAQGLSTKDMVVLSGAHTIGQARCTSFRARI
YNESNINAAYATSLKTNCPTTGSDNNLSPLDRVTPTTFDINYYSNLRSQKGLL
HSDQQLYNGGSTVSMVTTYSNN</u>KKTFFSEFPTSMINMGNINPLTGTSGEIRK
NCRKPN

Figure 88: Amino Acid sequence of SeqID 358. The conserved haem peroxidase family domain is underlined. The peroxidases active site signature and the peroxidases proximal heme-ligand signature are in bold.

MALPSLRVIWVFVLLLILATVQAQLTANFYKESCPNLENL<u>VIDVVAQAVRKEA</u>
<u>RMAASLLRLHFHDCFVNGCDGSILLDDTSSFQSEKNAGPNVNSARGFEVID</u>
<u>AIKSTVEKACPGVVSCADILTIVARDSVVLSAGPYWEVVLGRRDSTSASVDT</u>
<u>ANTDIPSPAFDVNRLVSTFQNQGLSPRDMVALSGAHTIGQARCVVFRNRIY</u>
<u>NETTTIDGRYASVMHGRCPTSGGGDNNLSPLDFGSATRFDNRYFTNVEAKR</u>
<u>GLLHSDQQLFSGGDTSIASLVHSYAAN</u>PPTFFNDFQRAMINMGNIKPLTGTN
GQIRTNCRMVNS

Figure 89: Amino Acid sequence of SeqID 359. The conserved haem peroxidase family domain is underlined.

MKTTGMARIMCAASFLIFACASTNAAGGLQLNFYDQTCPGVSNV<u>VEEVVAS</u>
<u>YISRAPTLAAALLRMHFHDCFVRGCDGSVLLNSTKSSKAEKDAPPNLSLRGF</u>
<u>QVIDAAKAAVEKLCPRVVSCADILALVARDAVHMLGGPFWNVPTGRRDGVV</u>
<u>SIANEAVAKLPPPNGTFSKLKSIFASNGLDVKDLVVLSGGHTIGISHCNSFSG</u>
<u>RLYNFTGKGDMDPSLDKNYAARLKIKCKLGDNKTIVEMDPGSFRTFDTNYFV</u>
<u>NVKKNRGLFQSDAALLTDNEAQSYINQ</u>QLQYLSFFSDFAVSMEKMGRIRVLT
GAVGQIRRHCAFAN

Figure 90: Amino Acid sequence of SeqID 360. The conserved haem peroxidase family domain is underlined. The peroxidases active site signature and the peroxidases proximal heme-ligand signature are in bold.

MASTAAMRIAITRVWCVVFFVTCVYGQLNPHFYDKTCPEALSI<u>VNSTVVQAIS
EERRIGASLLRLHFHDCFVNGCDGSVLLDDTSSFTGEKTAVPNNNSARGFE
VVDKIKKKLEQACSGVVSCADILAIAARDSVVTLGGPTWTVMLGRRDSRTAS
RSDANNNIPPPTSDLAKLISKFRAQGLSKREMVALSGAHTIGKARCVNFRGH
IYNDSNIDKAYAKSLQDRCPKSGDDNKLSPLDYKTPTKFENNYYKNLVAEKG
LLHSDQELFNGVSTDSLVTEYSKN</u>LELFERDFTAAIIKMGNITPLTGSQGEIRE
NCRKRNSDSAIFLSSTHLIHNE

Figure 91: Amino Acid sequence of SeqID 361. The conserved phenylalanine ammonia-lyase family domain is underlined. The phenylalanine/histidine ammonia-lyase family domain is in bold and the phenylalanine and histidine ammonia-lyases signature is in bold/italics.

MVAGSDLGAVQANGNQNGNGFHHVHSVDLCIQNGP<u>DPLNWGQAAKALQG</u>
<u>SHFEEVKLMVESYFGSE</u><u>EVSIEGKSLTIADVTAVARRPEAKVKLDAVSAKA</u>
<u>RVDESSNWVLQNMLKGTDTYGVTTGFGATSHRRTNQGAELQKELIRFLNS</u>
<u>GVLTDGNVLPQETTRAAMLVRTNTLMQGYSGIRWEILETIQKLLNAGITPKL</u>
**<u>PLK</u>*<u>GTITASGDLVPLSYI</u>*<u>AGFITGRPNSRARCRDGKELGALEALQQIGVEKP</u>**
<u>FELQPKEGLAIVNGTSVGAALASIVCFDANIICIAAEVLSAMFCEVMLGKPEF</u>
<u>TDPLTHRLKHHPAQMEAAAIMEYVLDGSSYMKNAAKKHEMNPLQKPKQD</u>
<u>RYALRTSPQWLGPQIEVIRSATHMIQREINSVNDNPVIDVARDKALHGGNF</u>
<u>QGTPIGVSMDNLRLALAAIGKLMFAQFSELVNDYYNGGLPSNLSGGPNPS</u>
<u>LDYGFKGAEIAMASYTSELQYLASPVTTHVQSAEQHNQDVNSLGLISARKS</u>
<u>AEAIDILNLMVSTYLLALCQAADLRHLEENMLSTVKSVVSHVAKKMLSTHN</u>
<u>GELLTAGRFCEKDLLQAVENLHVFAYVDDPCNENYPLMQQLRQVLVAHALT</u>
<u>ETAQIQTQTQSSIFNKIPAFEKELKDQMEAEIGRARQDYYERGVAGSIPNRIQ</u>
<u>ECRSFPLYDFARSQLGTQLLSGDRVTSPGEYIEKVYTGIREGKIISPLFKCLD</u>
<u>GWSGTPGPFHS</u>

Figure 92: Amino Acid sequence of SeqID 362. The conserved phenylalanine/histidine ammonia-lyase family domain is underlined and the phenylalanine and histidine ammonia-lyases signature is in bold.

MEYSHVKGKGCATAFTSHVKDIVLLINTFNEIKNINVDGSRITVAHVTALGRR
PQVKVTLDNHGGNCRERVERCSFWVQEKAKEGADIYGVTTGFGACSSKRT
NQLSELQEALIRCLLAGAFTCPSSSPGELSPITTRCAMFLRMNSFIYGCSGIR
WEIMEALQQLINTQITPKCPLRGSVSASGDLIPLAYIAGLLIGNPQVKARIGGH
GEEQEVAAPEALVKAGLQPFKLQAKEGLALVNGTSFATALAATVMYDANVL
LLLVEMLCGMFCEVIFGREEFTHPLIHELKPHPGQIQSAALLEWLLRNSPFQE
LSREYYSINSLKKPKQDRYALRSSPQWLAPLVQTIREATATIETEINSANDNPI
IDHVNGKALHGANFQGSAVGFYMDYARVALAGLGKLIFAQFTELMIEFYSNG
LPGNLALGPDLSLDYGFKGVDIAMAAYSSELQFLANPVTTHVHSAEQHNQDI
NSLALISARKTEEALDILKLMLASYLSALCQAIDLRQLEQILVKAVSGVISSVSD
ACHLPESIKEGLINVARGIPVYTYLESPCDPSFPLVSALKQTFLDSILVFHDLQI
VEQIQEFESHLKQRLEEELTATRLSYEQRNRIPMQEGSCFRTLIHGSKFFALY
AFIRDELNTKMMTPRTDQTPQQDIQKVFDAIVDGRITVPLLQCLNGFIN

Figure 93: Amino Acid sequence of SeqID 363. The conserved phenylalanine/histidine ammonia-lyase family domain is underlined and the phenylalanine and histidine ammonia-lyases signature is in bold.

MHSLHPLPVTSFQILQSLGTRDFLVTSLLFINFSVGRDHVVICGRREQQNGE
HKRINEVHGTVPTANVASAGAFDGKNPDHVTFPTHWKKAAEAMQCSHYEE
VRKMIKQFNTTRKVVLRGTTLTVAEVTAVTRRVEVRVELDEASAKERVERSY
QWVAKNVARGTDTYGVTTGFGATSHRRTDKAADLQKELIRFLNAGVVGKER
LCLPAEYTKAAMLVRTNTLMQGYSGIRWEILDALRKLMDVNITPKLPLRGTIT
ASGDLVPLSYIAGLLTARPNSKALSPDGHLLDAMEALRKAGILEPFKLQPKE
GLALVNGTAVGSAVAASVCFDANVLGVLAEILSALFCEVMQGKPEFVDPLTH
QLKHHPGQIEAAAVMEFLLDGSDYVKEAARLHEKDPLSKPKQDRYALRTSP
QWLGPPIEVIRAATHSIEREINSVNDNPLIDVSRDMALHGGNFQGTPIGVSMD
NMRISLAAVGKLLFAQFSELVCDYYNNGLPSNLSGGPNPSLDYGFKGAEIAM
AAYTSELQYLANPVTTHVQSAEQHNQDVNSLGLISARKTAEAVEILKLMFAT
YLVALCQAIDLRHLEENMRSVVKHVVLQAGRKTLCTAEDGSLHDTGFCEKEL
LQVIDHQPVFSYIDDPTNPSYALMLQLREVLVDEALKSSCPDGNAESDHNLQ
PAESAGAAGILPNWVFSRIPIFQEELKARLEEEVPKARERFDNGDFPIXKQNK
QVQDISHLQIREIRVGNRFANRAQVEKPGEDIEKVFEGICQGKIGDVILKCLD
AWGGCAGPFTPRAYPASPAAFNASYWAWFDSTKSPSATSGRGFWSAQQQ
QVL

Figure 94: Amino Acid sequence of SeqID 364. The conserved phenylalanine/histidine ammonia-lyase family domain is underlined and the phenylalanine and histidine ammonia-lyases signature is in bold.

MAPQEFTGEVKFCAGNGGTASLNDPLNWAAAAESMKGSHFEEVKRMWEE
FRSPVVRLQGSGLTIAQVAAVARRMGSVRVELETGAKAWVDESSNWVMDS
MANGTDSYGVTTGFGATSHRRTRQGEALQKELIRFLNAGIFGGCGDSNSLP
RDTTRAAMLVRANTLLQGYSGIRWGILEAMSGLLNAGITPRLPLR**GTITASG
DLVPLSYIA**GLLTGRSNARAVTADGTELGAAEALAAAGVENGPFELRPKEGL
ALVNGTAVGSALAATVLFDANVVVLLSEVLSALFCEVMQGNPEFTDHLTHRL
KHHPGQIEAAAIMEHLLDGSSYMKAAAAKHQEADALSKPKQDRYALRTAPQ
WLGPQVEVIRASTHMVQREINSVNDNPLIDAARNKALHGGNFQGTPVGVAM
DNARLALAAVGKLMFAQMSELVNDFYNNGLPSNLSGGPDPSLDYGFKGAEI
AMAAYTSELQFLANPVTTHVQSAEQHNQDVNSLGLISARMTAQAVDILKLMT
STYLVALCQAIDLRHLEENLLAAVRQSVGQACKKTLVVGPRGELLPSRFCEK
DLLKAIDREPVFSYIDNPCSATSVLTTKLRQVLFEHAIEKTTNNDASILTRIPAF
EEELKARIVAEVQETRGAFEKGAALVPNRIKDCRSYPLYEFVRVELGTSLLV
GTNSRSPGEDFDKVFVAINEGKAVEPLFKCLERWNGAPIPI

Figure 95: Amino Acid sequence of SeqID 365. The conserved phenylalanine/histidine ammonia-lyase family domain is underlined and the phenylalanine and histidine ammonia-lyases signature is in bold.

MASQEFTGLMNLCAGNDRLNWASVAESMKGSHFEEVKRMVEEFRAP<u>VVRL</u>
<u>QGSGLTIAQVAAVARRLGSVRVELDTGARARVEESSNWVMDSMANGKAIY</u>
<u>GVTTGFGASSHRRTSHAEALQKEMARFLNAGIFGGCGDSNTLPRDATRAT</u>
<u>MLVRTNTLLQGYSGIRWGILEAMTGLLNAGITPRLPLRGSITASGDLVPLSYI</u>
<u>AGLLIGRPNARAVMADGTEVGAAEALAAAGVGNGPFVLRPKEGVALVNATA</u>
<u>VGSALAATVLFDANVVVLLSEVLSALFCEVMQGDPGFTNHLIHRLKDHPGQI</u>
<u>EAAAIMEHLLDGSSYMKAAATKNKEADPLSKPKKDRYALYTSPQWLGPQVE</u>
<u>VIRASTHMVQREINSVNDNPIIDAAGNKALNGGNFQGTPVGVAMDNVRLALA</u>
<u>AVGKLIFAQMSELVNDFYNKGLPSNLSGGPDPSLDYGFKGAEVAMASYTSE</u>
<u>LQFLANPVTTHVQSAEQHNQDVNSLGLISARMTAQAVEILKLMTSTYLVALC</u>
<u>QAIDLRHLEENLHAAVRQAVGEACKKTLVVGPR</u>GELLLLKAVDREPVFSYID
NPCSATSVLTTVLRQVLFEHALEKTTDNDGSILTRVPAFEEELKARIVADVHE
TRAACEKGTALVPNRIKDCRSYPLYEFVRVELGTSLLVGTDSRSPGEDFDKV
FVAINEGKAVAPLFKCLEGWNGAPIPI

Figure 96: Amino Acid sequence of SeqID 366. The conserved phenylalanine/histidine ammonia-lyase family domain is underlined and the phenylalanine and histidine ammonia-lyases signature is in bold.

MEYSQLNSNSCITGRYRSCHVEDIILLIKTFNEINCINVDGSRITVAHVTALGR
RPQVKVTLDNHGGNCRERVERCSLWVQEKAKGGADIYGVTTGFGACSSKR
TNQLSELQEALIRCLQAGVFTGPSSSPGELSPITARCAMFLRMSSFIYGCSGI
RWEIMEALQQLINSHITPKCPLRGSVSASGDLIPLAYIAGLLIGNPQVKARIGA
HGEEQEVPAPEALMKAGLQPFKLQAKEGLALVNGTSFATALAATVMYDANV
LLLLVEMLCGMFCEVIFGREEFAHPLIHEMKPHPGQRESAALLEWLLRDSPF
QELSREYYSINSLKKPKQDRYALRSSPQWLAPLVQTIREATATIETEINSAND
NPIIDPVNGKALHGANFQGSAVGFYMDYVRVALAGLGKLIFAQFTELMIEFYS
NGLPGNLSLGPDLSLDYGFKGIDIAMAAYSSELQFLANPVTTHVHSAEQHNQ
DINSLALICARKTEEALDILKLMLASHLYALCQAIDLRQLEQILLNIVLGIISSVS
DECHLQQSIKEQLISVARGIPVYTYLESPCNPSLPLVSALKQTFLDAIVTLHDI
QIVEQITEFESHLKQRLEEEITAIVLSYEERTNSHMLEGSCCRTLIHGSKFFPL
YAFIREELNAIMMTPRTDHTPQKGTQKVFDAIVDGRITAPLLECLNGFMN

Figure 97: Amino Acid sequence of SeqID 367. The conserved AMP dependent synthetase and ligase family domain is underlined and the AMP-binding domain signature is in bold.

MISVAPSPETAPQNPSEVPQGEKREAPAACTIFRSKLPDIPIPNHLSLHSYCF
EHVPQFPDRPCLISDSTGKSF<u>SFSDALLLSRKVAAGLHNLGIRRGDVVMTLL</u>
<u>QNCPEFAFSFMGASMIGAVTTTANPFYTPSEIFKQFAASRTKLVITQSLYVDK</u>
<u>LRDHADGNGPTLGKDFVVVTVDDPPEGCVHFSVLGEANEEEAPEVAIHPDD</u>
<u>PVALPFSSGTTGLPKGVILTHRNLITSIAQQVDGENPNLHLRAEDVMLCVLPL</u>
<u>FHIYSLNSVLLCSLRAGAGVLLMHKFEIGTLLQLIERHRVSVAAVVPPLVLALA</u>
<u>KNPLVEKFDLSSIRMVLSGAAPLGKELELALQTRLPGAILGQGYGMTEAGPV</u>
<u>LSMCLGFAKQPFPTKSGSCGTVVRNAELKVIDPETGSSLGYNQPGEICIRGQ</u>
<u>QIMKGYLNDPEATSITIDADGWLHTGDIGYVDDDDEIFIVDRVKEIIKFKGFQV</u>
<u>PPAELEALLVSHPSIADAAVVPQKDEVAGEVPVAFVVRSNGFELTEEAVKEFI</u>
AKQVVFYKKLHKVHFVHAIPKSPSGKILRKDLRAKLATAAPIS

Figure 98: Amino Acid sequence of SeqID 378. The conserved glycoside hydrolase, family 1, domain is underlined and the glycosyl hydrolases family 1 N-terminal signature is in bold..

MRSGACSALLLLLLLRLLLIHGLSLPLASSRTTV<u>HRGQFPPSFLFGTATSSFQI</u>
<u>EGAYLQGNKSLSNWDIFSHIPGKIEDGSNADVTDNHYNLFMEDIELMCDLGV</u>
<u>DAYRFSISWSRVLPKGRFGEVNSEGIEFYNNLIDALLVKGIKPFVTLNHYDIP</u>
<u>QLLEDRYGGWLSSEIQLDFGYFAQVCFEAFGDRVTYWTTFNEPNVFIYDGY</u>
<u>VVGTYPPGRCSYPFGNCSYGDSALEPYIATHNLVLSHATAAQIYRKNYQEK</u>
<u>QGGMIGIVISAAWYEPYSDTPADRLAVQRALAFDFAWFVDPFVYGDYPPEM</u>
<u>RQIVGSRLPTFSAEERNKLDAKLDFIGINHYTTKYAKDCMFSPCTSPYSLGEA</u>
<u>FVYVTGEKDGVYIGERTAMSDFFIVPRGIEGIVTYVKERYNNTPMFITENGYA</u>
<u>QFAGPIDDSLNDTKRIEYHEGYLAVLSEVVRKGADVRGYFIWSLLDNFEWLH</u>
<u>GYLVRFGLHYVDFQTLKRTPKWSATWCKEFLSEGNNTRPIRKTSTYEM</u>

Figure 99: Amino Acid sequence of SeqID 379. The conserved glycoside hydrolase, family 1, domain is underlined.

MRIRVPSMLLLWSLLGLVARSTMAEETVIPETTRFDTGGL<u>SRSAFPKGFVWG
TATSAYQVEGMADKEGRGPSIWDVFVKIPGIVAGNATGEVSVDQYHRYKED
VDLMAKLNFDAYRFSISWSRIFPDGTGKVNWKGVAYYNRLIDYLLSKGITPY
ANLYHYDLPEALEKKYQGLLSPNVVKDFADYADFCFKTFGDRVKNWMTFNE
PRVVAALGYDNGFFAPGRCSKAYGNCTAGNSGTEPYIVAHHLILSHAAAVQ
RYREKYQEKQKGRIGILLDFVWYEPLTRSKADNYAAQRARDFHVGWFIHPIV
YGEYPRTMQNIVGDRLPKFTKEEVKMVKGSMDFVGINQYTAYYINDPNQPK
AKVPGYQQDWNAGFAYAKLGVPIGPKAHSYWLYNVPWGLYKAVMYIKERY
GNPPVILSENGMDDPGNVTLSQGLHDTTRINFYKGYLTQLKKAVDDGANLV
GYFAWSLLDNFEWRLGYTSRFGIVYVDYTNLKRYPKMSAYWFKQLLTRKKN</u>

Figure_100: Amino Acid sequence of SeqID 380. The conserved glycoside hydrolase, family 1, domain is underlined.

MRIRVPSMLLLWSLLGLVARSTMAEETVIPETTRFDTGGLSRSAFPKGFVWG
TATSAYQVEGMADKEGRGPSIWDVFVKIPGIVAGNATGEVSVDQYHRYKED
VDLMAKLNFDAYRFSISWSRIFPDGTGKVNWKGVAYYNRLIDYLLSKGITPY
ANLYHYDLPEALEKKYQGLLSPNVVKDFADYADFCFKTFGDRVKNWMTFNE
PRVVAALGYDNGFFAPGRCSKAYGNCTAGNSGTEPYIVAHHLILSHAAAVQ
RYREKYQEKQKGRIGILLDFVWYEPLTRSKADNYAAQRARDFHVGWFIHPIV
YGEYPRTMQNIVGDRLPKFTKEEVKMVKGSMDFVGINQYTAYYINDPNQPK
AKVPGYQQDWNAGFAYAKLGVPIGPKAHSYWLYNVPWGLYKAVMYIKERY
GNPPVILSENGMDDPGNVTLSQGLHDTTRINFYKGYLTQLKKAVDDGANLV
GYFAWSLLDNFEWRLGYTSRFGIVYVDYTNLKRYPKMSAYWFKQLLTRKKN

Figure_101: Amino Acid sequence of SeqID 381. The conserved glycoside hydrolase, family 1, domain is underlined.

MRIRVPSMLLLWSLLGLVARSTMAEETVIPETTRFDTGGL<u>SRSAFPKGFVWG
TATSAYQVEGMADKEGRGPSIWDVFVKIPGIVAGNATGEVSVDQYHRYKED
VDLMAKLNFDAYRFSISWSRIFPDGTGKVNWKGVAYYNRLIDYLLSKGITPY
ANLYHDLPEALEKKYQGLLSPNVVKDFADYADFCFKTFGDRVKNWMTFNE
PRVVAALGYDNGFFAPGRCSKAYGNCTVGNSGTEPYIVAHHLILSHAAAVQ
RYREKYQEKQKGRIGILLDFVWYEPLTRSKADNYAAQRARDFHVGWFIHPIV
YGEYPRTMQNIVGDRLPKFTKEEVKMVKGSMDFVGINQYTAYYINDPNQPK
AKVPGYQQDWNAGFAYAKLGVPIGPKAHSYWLYNVPWGLYKAVMYIKERY
GNPPVILSENGMDDPGNVTLSQGLHDTTRINFYKGYLTQLKKAVDDGANLV
GYFAWSLLDNFEWRSGYTSRFGIVYVDYTNLKRYPKMSAYWFKQLLTRKKN</u>

Figure_102: Amino Acid sequence of SeqID 382. The conserved glycoside hydrolase, family 1, domain is underlined and the glycosyl hydrolases family 1 N-terminal signature is in bold.

MEVSQLKKAIFIIQIVLASLFTSSNSIMTSD<u>GPSSLPVNFLFGTASSSYQFEGA</u>
<u>YKSDGKGLNNWDVFAHEPGNIIDGSTGDIAVDHYHRYLEDIRLMESLGVNSY</u>
<u>RFSISWARILPKGRFAEINMAGIHYYNRLINSLLQKGIQPFVTLTHFDIPQELE</u>
<u>DRYGGWLSPKSQEDFGYFADICFRYFGDRVKYWVTFNEPNIQATLAYRWG</u>
<u>EFPPARCSAPFGNCTLGDSEMEPFIVAHNMILSHATAVNIYRTNYQKEQGGII</u>
<u>GIVIHAAWFEPISNSLADELAAERAMSFFMSWFLDPIIFGKYPAEMIEILGSILP</u>
<u>EFSRSDQEKLKKGLDFIGINHYTSYYVQDCILSICEPGKGITKTEGYYKQSSE</u>
<u>KNGVPIGQPTDLEWLNVYPQGMEYMVTYVKERYNNTPMFITENGYGEKDD</u>
<u>LKLKDEKPLEDLKRVEYMASHLSALLSAVRKGADVRGYFAWSLLDNFEWQF</u>
<u>GYTERFGLHHVNFTTLKRTPKLSASWYKQFIAEHSIRTIT</u>DPDHPNL

Figure 103: Amino Acid sequence of SeqID 383. The conserved glycoside hydrolase family 1 domain is underlined, and the glycosyl hydrolase family 1 N-terminal signature is in bold MEVSQLKKAIFIIQIVLASLFTSSNSIMTSDGPSSLPGNFLFGTASSSYQFEGA
YKSDGKGLNNWDVFAHEPGNIIDGSTGDIAVDHYHRFLEDIRLMESLGVNSY
RFSISWARILPKGRFAEINMAGIHYYNRLINSLLQKGIQPFVTLTHFDIPQELE
DRYGGWLSPKSQEDFGYFADICFRYFGDRVKYWVTFNEPNIQATLAYRWG
EFPPARCSAPFGNCTLGDSEMEPFIVAHNMILSHATAVNIYRTNYQKEQGGII
GIVIHAAWFEPISDSLADKLATERAVSFFMSWFLDPIIFGKYPAEMIEILGSILP
EFSRSDQEKLKKGLDFIGINHYTSYYVQDCILSICEPGKGITKTEGYYKQSSE
KNGVPIGQPTDLEWLNVYPQGMEYMVTYVKERYNNTPMFITENGYGEKDD
LKLKDEKPLEDLKRVEYMASHLSALLSAVRKGADVRGYFAWSLLDNFEWQF
GYTERFGLHHVNFTTLKRTPKLSASWYKQFIAEHSIRTITDPDHPNLQQIY Figure 104: Amino Acid sequence of SeqID 384. The conserved glycoside hydrolase, family 1, domain is underlined and the glycosyl hydrolases family 1 N-terminal signature is in bold.

MRSQPCSILLRLLLIHGLFLRLTSSRTTV<u>HRGQFPPSFLFGTATSSFQIEGGY</u>
<u>LQGNKSLSNWDVFSHMPGKIEDGSNADVADDHYNLFLEDIQLMHSLGVDAY</u>
<u>RFSIAWSRVLPQGRFGEVNSEGIEFYNNIIDALLVRDIKPFVTLNHYDLPQLLE</u>
<u>DRYGSWLSSEIQLDFGYFAQVCFEAFGDRVTYWSIFNEPNVLIYHGYLLGTY</u>
<u>PPGRCSYPFGNCSYGDSALEPYIATHNLVLSHATAAEIYRKYYQEKQGGMIG</u>
<u>IVISAPWFEPYDDTPADRLAVQRSLAFYIAWFVDPLVYGDYPPEMRQVLGSR</u>
<u>LPTYSAEERKKLLEGKLDFIGVNHYTTLYVKDCMFSSCASPYSLGDAFVYLT</u>
<u>GEKDGAYIGERTAMPLFFVVPRGMEGIVTYVKERYNNTPMFITENGYAQPA</u>
<u>GAIKDSLNDTKRIEYHENYLAVLSEVVRKGADVRGYFIWSLLDNFEWLYGYLI</u>
<u>RFGLHYVDFQTLKRTPKWSATWYTEFLSEDNKIRAIRKTSTYKM</u>

Figure 105: Amino Acid sequence of SeqID 385. The conserved glycoside hydrolase, family 1, domain is underlined and the glycosyl hydrolases family 1 N-terminal signature is in bold.

MTKKLGFLLRLLVVGLVIAETVHGAYEF<u>SRYDFPPGFVFGAGTSAYQVEGAA</u>
<u>NEDGRTPSIMDTWAHSDSGITSGANGDIACDQYHKYKVDVQLMAEMGLDA</u>
<u>YRFSISWSRLIPNGRGSVNPKGLQYYNNLINELISHGIEPHVTLHHFDLPQAL</u>
<u>EDEYGGWISRNIVRDFAEYADVCFKIFGDRVKYWTTFNEANIFSMAGYDLGF</u>
<u>MPPSRCSSPFGFLNCTRGDSLLEPYLAAHNILLSHASATRLYWKKYQNIQKG</u>
<u>YIGLNLLSFYSVPFTNKTEDVIAARRVTDFFMGWFVEPLVYGDYPEVMKNNA</u>
<u>GSRLPSFTALESQRVKGSFDFFAVNFYSANYVKDNPESLNIEPRDYFTDMAV</u>
<u>QWKYKQGNASSFMNRFPPSFEFPLTPWGLQGVLELFKQNYGNPPIFIYENG</u>
<u>QRMQRNTSLEDWPRIQYLQEHISVLLDTVRNGSNAKGYFTWSLLDVFELLD</u>
<u>GYRSGYGLYYVDLDDPELRRYPKLSAKWYSRFLKGGSITPDSS</u>IELEGNWS
SLSSAQAMR

Figure 106: Amino Acid sequence of SeqID 386. The conserved glycoside hydrolase, family 1, domain is underlined and the glycosyl hydrolases family 1 N-terminal signature is in bold.

MTKKLGFLLRLLVVGLVIAETVHGAYEF<u>SRYDFPPGFVFGAGTSAYQVEGAA</u>
<u>NEDGRTPSIMDTWAHSDSGITSGANGDIACDQYHKYKVDVQLMAEMGLDA</u>
<u>YRFSISWSRLIPNGRGSVNPKGLQYYNNLINELISHGIEPHVTLHHFDLPQAL</u>
<u>EDEYGGWISRNIVRDFAEYADVCFKIFGDRVKYWTTFNEANIFSMAGYDLGF</u>
<u>MPPSRCSSPFGFLNCTRGDSLLEPYLAAHNILLSHASATRLYWKKYQNIQKG</u>
<u>YIGLNLLSFYSVPFTNKTEDVIAARRVTDFFMGWFVEPLVYGDYPEVMKNNA</u>
<u>GSRLPSFTALESQRVKGSFDFFAVNFYSANYVKDNPESLNIEPRDYFTDMAV</u>
<u>QWKYKQGNASSFMNRFPPSFEFPLTPWGLQGVLELFKQNYGNPPIFIYENG</u>
<u>QRMQRNTSLEDWPRIQYLQEHISVLLDTVRNGSNAKGYFTWSLLDVFELLD</u>
<u>GYRSGYGLYYVDLDDPELRRYPKLSAKWYSRFLKGGSITPDSS</u>IELEGNWS
SLSSAQAMR

Figure 107: Amino Acid sequence of SeqID 387. The conserved glycoside hydrolase, family 1, domain is underlined. The glycosyl hydrolases family 1 N-terminal signature and glycosyl hydrolases family 1 active site is in bold.

MELKKQHPHGYLYANTRGGASASWCISLLMITATFLGCSCGREDPGVAGVN
GDDDKIINRTSFPSDFVFGVGSSAYQSEGAADQQGRGLSIWDTFTKLFPDKI
SDHSSGFIADEFYYQFQEDINLLKAMGWDFFRFSISWPRIAPHGKISKGVNE
QGVAFYNNLIDSLLAEGIQPFVTLFHWDVPQALEDEYGGFLSINIVEDYIDYV
NFCFQKFGDRVKHWVTLNEPNYFTLYGYAMGIYAPGRCSSYINNCTAGNSA
TEPYIVAHHLLLSHAAAVKLYRDNYQATQNGKIGMVIATYWMTPKYSTNVSR
KAASRAFDFQFGWFAHPITYGDYPKSMRRYVGERLPKFTKAQSEALKGSRD
YMGVNYYTARYVDESASPFTTLNLSYTTDCHCNMTAEKDGIPIGQPTAAEW
LYIYPKGIRELMHYVKKNYLDPTIYVTENGMADANNKSLPLEDALTDRLRISY
FQLHLSNLSKAIEEGVNVKGYFAWSFLDDFEWVEGYTTRYGLVFVDYGNEL
KRYMKHSACWFQSFLQKDNATVNYSLRSDA

Figure 108: Amino Acid sequence of SeqID 388. The conserved glycoside hydrolase, family 1, domain is underlined.

MMKKLGFLLQLVVVGLVIAETVSAADEFSRYDFPPGFVFGAGTSAYQVEGA
ANEDGRTPSIMDTWAHSDSVITGGANGDIACDQYHKYKEDVQLMAEMGLD
AYRFSISWSRLIPNGRGSVNPKGLQYYNNLINELISHGIEPHVTLHHFDLPQA
LEDEYGGWISRNIVKDFVEYADACFKIFGDRVKYWTTFNEANIFSMAGYDLG
FLPPNRCSSPFGYFNCTRGDSSLEPYMAAHNILMSHASATRLYRKKYQNIQ
KGYVGLNLLSFYSVPFTNKTEDVIAAQRSNEFFLGWFVEPLVYGDYPEVMK
KNAGSRLPSFTALESQRVKGSFDFFAVNFYSSNYIKDDPESLSIEPRDYKAD
MAVEWKYTQGNAMSFMNRFLPSFEFPLTPWGLQGVLELFKQNYGNPPIFIH
ENGQRMQRNTTLEDWPRIHCLQEHISVLLDTVRNGSNVKGYFTWSLLDVFE
LLDGYQSGYGLYYVDLDDPELRRYPKLSAKWYSRFLKGGSITPDGGIELEG
NRSSLSSAQAMR

Figure 109: Amino Acid sequence of SeqID 389. The conserved glycoside hydrolase, family 1, domain is underlined.

MELKKQHPHGYLYAITRGASASASASASSCIGLLMITATFLGCSCGREDPGVAG
VNGEDDKII<u>NRTSFPSDFVFGVASSAYQIEGAAADQQGRGLSIWDTFTELFP
DKISDHSSGFIADEFYYKFQEDINLLKAMGWDFFRFSISWPRIAPHGKISKEV
NKQGVAFYNNLIDSLLAEGIQPFVTLFHWDVPQALEDEYGGFLSLNIVEDYID
YVNFCFQEFGDRVKHWVTVNEPNYFTILGYAMGINAPGRCSSYINNCTAGN
SATEPYIVAHHLLLSHAAAVKLYRDNYQAAQKGKIGMVIATYWMTPKYSTNA
SRKAASRAFDFEFGWFAHPITYGDYPKSMRRYVGERLPKFTKTQSEALKGS
RDYMGVNYYTARYVDESASPFTALNLSYTTDCQCNMTVEKDEIPIGQPTAE
EWLYIYPKGIRELMHYVKKNYQDPTIYVTENGMADANNKSLPLEDALTDRLRI
SYFQLHLSNLSKAIEEGVNVKGYFAWSFLDDFEWAEGYTTRFGLVFVDYGN
GLMRHMKHSAYWFQSFLQKDNATVNY</u>SLRSDA

Figure 110: Amino Acid sequence of SeqID 390. The conserved zinc-containing alcohol dehydrogenase superfamily domain is underlined and the zinc-containing alcohol dehydrogenases signature is in bold.

MSSEGGKEDCLGWAA<u>RDPSGFLSPYKFTRRAVGSEDVSIKITHCGVCYADV</u>
<u>AWTRNVQGHSKYPLVPGHEIVGIVKQVGSSVQRFKVGDHVGVGTYVNSCR</u>
<u>ECEYCNDRLEVQCEKAVLTFDGIDADGTVTKGGYSSHIVVHERYCFRIPENY</u>
<u>PMDLAAPLLCAGITVYTPMIRHKMNQPGKSLGVIGLGGLGHMAVKFGKAFGL</u>
<u>KVTVLSTSISKKEEALSLLGADHFVISSDVEQMKAIAKSLDFIIDTAAGDHPFD</u>
<u>PYMSLLKTGGILALVGFPSEVKFSPASLNLNMRTVTGSVTGGTKDTQEMIDL</u>
<u>CAAQKIYPNIEVIPIDYANEALERLIKRDVKYRFVIDIENSLK</u>

Figure 111: Amino Acid sequence of SeqID 391. The conserved zinc-containing alcohol dehydrogenase superfamily domain is underlined and the zinc-containing alcohol dehydrogenases signature is in bold.

MSSEGGKEDCLGWAA<u>RDPSGFLSPYKFTRRAVGSEDVSIKITHCGVCYADV</u>
<u>AWTRNVQGHSKYPLVPGHEIVGIVKQVGSSVQRFKVGDHVGVGTYVNSCR</u>
<u>ECEYCNDRLEVQCEKAVLTFDGIDADGTVTKGGYSSHIVVHERYCFRIPENY</u>
<u>PMDLAAPLLCAGITVYTPMIRHKMNQPGKSLGVIGLGGLGHMAVKFGKAFGL</u>
<u>KVTVLSTSISKKEEALSLLGADHFVISSDVEQMKAIAKSLDFIIDTAAGDHPFD</u>
<u>PYMSLLKTGGILALVGFPSEVKFSPASLNLNMRTVTGSVTGGTKDTQEMIDL</u>
<u>CAAQKIYPNIEVIPIDYANEALERLIKRDVKYRFVIDIENSLK</u>

Figure 112: Amino Acid sequence of SeqID 392. The conserved zinc-containing alcohol dehydrogenase superfamily domain is underlined and the zinc-containing alcohol dehydrogenases signature is in bold.

MSSEGGKEDCLGWAARD<u>TSGFLSPYKFTRRAVGSEDISIKITHCGVCYADV
AWTRNVQGHSKYPLVPGHEIVGIVKQVGSSVQRFKVGDHVGVGTYVNSCR
ECEYCNDRLEVQCEKRVLTFDGIDADGTVTKGGYSSHIVVHERYCFRIPENY
PMDLAAPLLCAGITVYTPMIRHRMNQPGKSLGVIGLGGLGHMAVKFGKAFG
LKVTVLSTSISKKEEALSLLGADHFVISSDVEQMKAIAKSLDFIIDTAAGDHPF
DPYMSLLKTGGILALVGFPSEVKFSPASLNLNMRTVSGSVTGGTKDTQEMID
LCAAQKIYPNIEVIPIDYANEALERLIKRDVKYRFVIDIENSLK</u>

Figure 113: Amino Acid sequence of SeqID 393. The conserved zinc-containing alcohol dehydrogenase superfamily domain is underlined and the zinc-containing alcohol dehydrogenases signature is in bold.

MSSEGGKEDCLGWAA<u>RDPSGFLSPYKFTRRAVGSEDVSIKITHCGVCYADV</u><u>AWTRNVQGHSKYPLVPGHEIVGIVKQVGSSVQRFKVGDHVGVGTYVNSCR</u><u>ECEYCNDRLEVQCEKSVMTFDGIDADGTVTKGGYSSHIVVHERYCFRIPEN</u><u>YPMDLAAPLLCAGITVYTPMIRHKMNQPGKSLGVIGLGGLGHMAVKFGKAF</u><u>GLKVTVLSTSISKKKEALSLLGANHFIISSDLEQMKAIAKSLDFIIDTAAGDHPF</u><u>DPYRSLLKTGGILALVGVPSEVKFSPASLNLNMRTVTGSVTGGTKNTQEMID</u><u>LCAAQKIYPNIEVIPIDYANEALERLIKRDVKYRFVIDIENSLK</u>

Figure 114: Amino Acid sequence of SeqID 394. The conserved zinc-containing alcohol dehydrogenase superfamily domain is underlined and the zinc-containing alcohol dehydrogenases signature is in bold.

MGSLEKERTTTGWAA<u>RDPSGVLSPYTYSLRNTGPEDLYIKVLSCGICHSDIH</u>
<u>QIKNDLGMSHYPMVPGHEVVGEVLEVGSEVTKYRVGDRVGTGIVVGCCRS</u>
<u>CGPCNSDQEQYCNKKIWNYNDVYTDGKPTQGGFAGEIVVGQRFVVKIPDG</u>
<u>LESEQAAPLMCAGVTVYSPLVRFGLKQSGLRGGILGLGGVGHMGVKIAKAM</u>
<u>GHHVTVISSSDKKRTEALEHLGADAYLVSSDENGMKEATDSLDYIFDTIPVVH</u>
<u>PLEPYLALLKLDGKLILTGVINAPLQFISPMVMLGRKSITGSFIGSMKETEEML</u>
<u>EFCKEKGLTSQIEVIKMDYVNTALERLEKNDVRYRFVVDVVGSKLD</u>

Figure 115: Amino Acid sequence of SeqID 395. The conserved zinc-containing alcohol dehydrogenase superfamily domain is underlined and the zinc-containing alcohol dehydrogenases signature is in bold.

MGSLEKERTTTGWAARDPSGVLSPYTYSLRNTGPEDLYIKVLSCGICHSDIH
QIKNDLGMSHYPMVPGHEVVGEVLEVGSEVTKYRVGDRVGTGIVVGCCRS
CGPCNSDQEQYCNKKIWNYNDVYTDGKPTQGGFAGEIVVGQRFVVKIPDG
LESEQAAPLMCAGVTVYSPLVRFGLKQSGLRGGILGLGGVGHMGVKIAKAM
GHHVTVISSSDKKRTEALEHLGADAYLVSSDENGMKEATDSLDYIFDTIPVVH
PLEPYLALLKLDGKLILTGVINAPLQFISPMVMLGRKSITGSFIGSMKETEEML
EFCKEKGLTSQIEVIKMDYVNTALERLEKNDVRYRFVVDVVGSKLD

Figure 116: Amino Acid sequence of SeqID 396. The conserved zinc-containing alcohol dehydrogenase superfamily domain is underlined and the zinc-containing alcohol dehydrogenases signature is in bold.

MGSVDAERKTTGWAA<u>RDPSGTLAPYTYDLRSTGPEDAYIRVLYCGICHSDIH
QIKNDLGMSRYPMVPGHEVVGEVLEVGSEVTGLRVGDRVGVGVLVGCCRN
CTPCKSDIEQYCSKKIWSYNDVYTDGKPTQGGFAGEMVVAQKFLVKIPDGIS
SEQAAPLLCAGVTVYSPLNHFGLKQSGLRGGILGLGGVGHMGVKIAKAMGH
HMTVISSSDRKREEALDHLGADAYLVSSDETGMKEAADSLDYIIDTVPVFHPL
EPYLSLLKLDGKLILLGVINTPLQFLTPVVMGGRKAITGSFIGSMKETKEMLDF
CEEKGITSQIEVIKMDYINAAFERLEKNDVRYRFVVDVAGSKLD</u>

Figure 117: Amino Acid sequence of SeqID 397. The conserved zinc-containing alcohol dehydrogenase superfamily domain is underlined. The zinc-containing alcohol dehydrogenases signature is in bold and the D-isomer specific 2-hydroxyacid dehydrogenases NAD-binding signature is in italics.

MSSDGAKEDCLGWAA<u>RDPSGLL<i>SPYKFSRRTVGSDDVSIRI</i>THCGVCYADV</u>
<u>GWTRNMTGHSKYPLVPGHEMVGIVKQVGSSVQRFKVGDHVGVGTYVNSC</u>
<u>RECEYCNDGLEVHCEKMVLTFDGIDTDGTVTKGGYSSHIVVHERYCFRIPEN</u>
<u>YPMDLAAPLLCAGITVYTPMIRHKMNQPGKSLGVIGLGGLGHMAVKFGKAF</u>
<u>GLKVTVFSTSISKKEEALSLLGADHFVISSDVEQMQAIAKSLDFIIDTASGNHP</u>
<u>FDPYMSVLKTGGILALVGSSEVKFSPASLHHNMRTVSGSLTGGTKDTQEMID</u>
<u>LCAAQKIYPNIEVIPIDYANEALERLIKRDVKYRFVIDIENSLK</u>

Figure 118: Amino Acid sequence of SeqID 398. The conserved zinc-containing alcohol dehydrogenase superfamily domain is underlined and the zinc-containing alcohol dehydrogenases signature is in bold.

MANTMKAARF<u>LTQGGDLQIVDIEIPQPKAGEVRMKVHACGVCNSDKVVKMG
ILGNPYPRTPGHEAAGVVDAVGEGVSRFKKGDRVGLGWYAGHCGNCTPC
EENVWSCCDRGQIAGVSIDGGYAEYAVARESAFARIPDDLSFEEAAPLMCA
GVTVFNAMRNQDIRPGELVAIQGVGGLGHLAVQYASKMGFKVVAISSGADK
EQFAKELGAAHYINVGPGVDAAAELTKLGGAKMIVATAPNAESINPLVKGLKI
GGKLLVVGLPFEPLSISVFDLLQRNASVGSWSAGDSRDSEATMKFAAAKDV
KAKIEIFPLSEAQKAYDRMMENKARFRCVLKIV</u>

Figure 119: Amino Acid sequence of SeqID 399. The conserved zinc-containing alcohol dehydrogenase superfamily domain is underlined and the zinc-containing alcohol dehydrogenases signature is in bold.

MAKSPDQEHPCKAFGWAA<u>RDKSGLLSPLCFSRRENGDEDVTIKILFCGVCH</u>
<u>SDLHVAKNEWGFTNYPVVPGHEMVGTVMKVGSDVKKFKVGERVGVGVIVG</u>
<u>SCKKCESCQQDLENYCPQTIFTYNSHYTDGTKTYGGYSDMIVVDERYVLRF</u>
<u>PDNLPLEGGAPLLCAGITVYSPMKYYGMTEPGKHLGVAGLGGLGHVAVKM</u>
<u>GKAFGLKVTVISSSPKKETEAIERLGADSFLVTSDPAKMKAALGTMDYIIDTV</u>
<u>SAVHPLLPLLSLLKLNGKLVTVGLPDKPLELPIFPLVLGRKLVGGSDIGGMKE</u>
<u>TQEMLDFCAKHGITADVEVIQMDYINTAMERLAKSDVRYRFVIDVASSLSQ</u>

Figure 120: Amino Acid sequence of SeqID 400. The conserved zinc-containing alcohol dehydrogenase superfamily domain is underlined and the zinc-containing alcohol dehydrogenases signature is in bold.

MSSSQVITCKGVVC<u>WGAGEEWKVEEIQVDPPKGSEVRMKMLFASVCHTDV</u>
<u>LCSRGFPFPIYPRVLGHEGVGIVESVGEEVKELKKGDVVIPVFVGECGECEN</u>
<u>CNSEKTNLCLRHPLSFSGLLPDGTSRMSIRGQTLYHLLSCSTWSEYTVSDV</u>
<u>NYVMKVDPDVALPHASFLSCGFSTGFGAAWMDSKVESGSSVAVIGLGAVG</u>
<u>LGVVKGARVQGATTIIGVDKNGMKKDKGEAFGMTNFINPEAQQSSGNADSK</u>
<u>SISEMVKDLTGGVGVDYCFECSGVPDLINQALEATKVGKGKAVVVGAGLDQ</u>
<u>FVQISFLNLLMGRTLKGTIFGGLKSKTHLPLLLHKCKNKEILLDELLTHEMKLE</u>
<u>DVPKALDILKQSNCVKILIKI</u>

Figure_121: Amino Acid sequence of SeqID 401. The conserved zinc-containing alcohol dehydrogenase superfamily domain is underlined and the zinc-containing alcohol dehydrogenases signature is in bold.

MAKSPEQEHPQAAFGWAARDPSGLLSPFKFSRRTTGEKDVKFKVFFCGICH
SDLHSVRNEWGFSTYPLVPGHEIVGEVVEVGSKVEKFKAGDKVGVGCLVG
SCGSCDSCHDQLENYCPKMILTYGAMYHDGTMTHGGYSNMMVVDEHFAIK
FPQNMPLDAGAPLLCAGITVYSPMKFFGLDHPGIHLGLVGLGGLGHVAVKFA
KAMGVKVTVISSSPGKREEALQRLGADAFLISSDTNQVQAAMGTMDGIIDTV
SAVHPILPLIGLLKQNGKLVLVGAPDRPLELPVFPLIFGRKIVAGSCIGGIQET
QEMIDFAAKHKITADIEVISIDYVNTAMDRLAKGDVKYRFVIDIGNTLKEA

Figure 122: Amino Acid sequence of SeqID 402. The conserved zinc-containing alcohol dehydrogenase superfamily domain is underlined.

MAQETQNHTLSVSGWTAYDSSGEIKPYTFKRRENGVNDVTIKVLYCGICHT
DLHYAKNDWGITMYPVVPGHEITGVVIKVGCNAGKFKIGDRVGLGCLAASCL
KCEFCADSQENYCDQMQFTYNGIFRDGSITYGGYSNVIVADYRYVVRIPENL
PMDSVAPLLCAGITVFSPLKDNGMLGSPGKKMGVVGLGGLGHVAVKFGKAF
GHHVTVLSTSPSKETEAKGRLGADDFIVSTNSQQMQAGKRSLDFILDTVSAQ
HSLGPILELLKVDGTLVMVGAPDQPLELPSFPLIFGKRSVKGSMTGGMRDTQ
EMMDLCGKHNITCDVEVIAPDTINEAMDRLAKNDVRYRFVIDIAGRISNI

Figure 123: Amino Acid sequence of SeqID 403. The conserved zinc-containing alcohol dehydrogenase superfamily domain is underlined.

MAQETQNHTLSVSGWAA<u>YDSSGEIKPYTFKRRENGVNDVTIKVLYCGICHT
DLHYAKNDWGITMYPVVPGHEITGVVIKVGCNAGKFKIGDRVGVGCLAASCL
KCEFCADSQENYCDQMQFTYNGIFWDGSITYGGYSNVIVADYRYVVRIPEN
LPMDSVAPLLCAGITVFSPLKDNGMLGSPGKKMGVVGLGGLGHVAVKFGKA
FGHHVTVLSTSPSKETEAKGRLGADDFIVSTNSQQMQAGKRSLDFILDTVSA
QHSLGPILELLKVDGTLVMVGAPDQPLELPSFPLIFGKRSVKGSMTGGMRDT
QEMMDLCGKHNITCDVEVIAPDTINEAMDRLAKNDVRYRFVIDI</u>AGRISNI

Figure 124: Amino Acid sequence of SeqID 404. The conserved UDP-glucoronosyl/UDP-glucosyl transferase family domain is underlined and the UDP-glycosyltransferases signature is in bold.

MGSDAESLV<u>HVLLVSFPGQGHVNPLLRLGKRLASKGLLVTFTTPESIGKQM
RKASNIGDEPAPVGDGFIRFEFFEDGWDEDEPRRQDLDQYLPQLEKVGKVL
IPEMIRRNAERNRPISCLINNPFIPWVSDVAESLGLPSAMLWVQSCACFAAYY
HYYHGLVPFPSESAMEIDVRLPCMPLLKHDEVPSFLYPTSPYPFLRRAILGQ
YKNLDKPFCILMDTFQELELEIIEYMSKICPIKTVGPLFKNPKVPNANVRGDFM
KADDCVGWLDSKPAGSVVYVSFGSVVYLKQDQWDEIAYGLLNSNVNFLVV
MKPPHKDSGYTVLTLPEGFLEKAGDKGKVVQ**WSPQEQVLAHPAVAAFVTH
CGWNSSMEALASGMPVIAFPQWGDQ**VTDAKYLVDVFKVGVRMCRGEAED
KLITRDVVEKCLLEATVGEKAAEMKRNALKWKAAAEAAVAEGGSSDRNIQA
FMDEVKRRS</u>VEVALAKGSKSTVVEAPAAVREGAATNGKVELDSS

Figure 125: Amino Acid sequence of SeqID 405. The conserved UDP-glucoronosyl/UDP-glucosyl transferase family domain is underlined and the UDP-glycosyltransferases signature is in bold.

MGSEAL<u>VHVLLVSFPGQGHVNPLLRLGKRLASKGLLVTFTTPESIGKAMRKA</u>
<u>SNIGEELSPVGDGFIRFEFFEDGWDEDEIRRQDLDQYLPQLEKVGKVLIPEMI</u>
<u>RRNAEQGRPISCLINNPFIPWVSDVADSLGLPSAMLWVQSCACFTSYYYYY</u>
<u>HGLVPFPSETAMEIDVQLPCMPLLKHDEVPSFLYPTTPYPFLRRAIMGQYKN</u>
<u>LDKPFCILMDTFQELEHEIIEYMSKISPIKTVGPLFKNPKAPNATVKGDFMKAD</u>
<u>DCVGWLDSKPASSIVYVSFGSVVYLKQDQWDEIAYGLLNSGVNFLWVMKPP</u>
<u>HKDSGYEVLKMPEGFLEKAGDRGKVVQWSPQEQVLAHPSVACFVTHCGW</u>
<u>NSTMEALTSGMPVVAFPQWGDQVTDAKYLVDVFKVGVRMCRGEAENKLIT</u>
<u>RDVVEQCLREATSGPKAEEMKQNAMKWSAAAEAAVAEGGSSDRNIQAFVD</u>
<u>EVKRRSLEVLAVSGKSTANGVAELGEPKVNGELKVVS</u>

Figure 126: Amino Acid sequence of SeqID 406. The conserved UDP-glucoronosyl/UDP-glucosyl transferase family domain is underlined and the UDP-glycosyltransferases signature is in bold.

MGSEALVHVLLVSFPGQGHVNPLLRLGKRLASKGLLVTFTTPESIGKAMRKA
SNIGEELSPVGDGFIRFEFFEDGWDEDEIRRQDLDQYLPQLEKVGKVLIPEMI
RRNAEQGRPISCLINNPFIPWVSDVADSLGLPSAMLWVQSCACFTSYYYYY
HGLVPFPSETAMEIDVQLPCMPLLKHDEVPSFLYPTTPYPFLRRAIMGQYKN
LDKPFCILMDTFQELEHEIIEYMSKISPIKTVGPLFKNPKAPNATVKGDFMKAD
DCVGWLDSKPASSIVYVSFGSVVYLKQDQWDEIAYGLLNSGVNFLWVMKPP
HKDSGYEVLKMPEGFLEKAGDRGKVVQ**WSPQEQVLAHPSVACFVTHCGW
NSTMEALTSGMPVVAFPQWGDQ**VTDAKYLVDVFKVGVRMCRGEAENKLIT
RDVVEQCLREATSGPKAEEMKQNAMKWSAAAEAAVAEGGSSDRNIQAFVD
EVKRRSLEVLAVSGKSTANGVAELGEPKVNGELKVVS

Figure 127: Amino Acid sequence of SeqID 407. The conserved UDP-glucoronosyl/UDP-glucosyl transferase family domain is underlined and the UDP-glycosyltransferases signature is in bold.

MGSEALV<u>HVLLVSFPGQGHVNPLLRLGKRLASKGLLVTFTTPESIGKAMRKA
SNIGEELSPVGDGFIRFEFFEDGWDEDEIRRQDLDQYLPQLEKVGKVLIPEMI
RRNAEQGRPISCLINNPFIPWVSDVADSLGLPSAMLWVQSCACFTSYYYYY
HGLVPFPSETAMEIDVQLPCMPLLKHDEVPSFLYPTTPYPFLRRAIMGQYKN
LDKPFCILMDTFQELEHEIIEYMSKISPIKTVGPLFKNPKAPNATVKGDFMKAD
DCVGWLDSKPASSIVYVSFGSVVYLKQDQWDEIAYGLLNSGVNFLWVMKPP
HKDSGYEVLKMPEGFLEKAGDRGKVVQ**WSPQEQVLAHPSVACFVTHCGW
NSTMEALTSGMPVVAFPQWGDQ**VTDAKYLVDVFKVGVRMCRGEAENKLIT
RDVVEQCLREATSGPKAEEMKQNAMKWSAAAEAAVAEGGSSDRNIQAFVD
EVKRRS</u>LEVLAVSGKSTANGVAELGEPKVNGELKVVS

Figure 128: Amino Acid sequence of SeqID 408. The conserved UDP-glucoronosyl/UDP-glucosyl transferase family domain is underlined and the UDP-glycosyltransferases signature is in bold.

MGSEALVHVLLVSFPGQGHVNPLLRLGKRLASKGLLVTFTTPESIGKAMRKA
SNIGEELSPVGDGFIRFEFFEDGWDEDEIRRQDLDQYLPQLEKVGKVLIPEMI
RRNAEQGRPISCLINNPFIPWVSDVADSLGLPSAMLWVQSCACFTSYYYYY
HGLVPFPSETAMEIDVQLPCMPLLKHDEVPSFLYPTTPYPFLRRAIMGQYKN
LDKPFCILMDTFQELEHEIIEYMSKISPIKTVGPLFKNPKAPNATVKGDFMKAD
DCVGWLDSKPASSIVYVSFGSVVYLKQDQWDEIAYGLLNSGVNFLWVMKPP
HKDSGYEVLKMPEGFLEKAGDRGKVVQ**WSPQEQVLAHPSVACFVTHCGW
NSTMEALTSGMPVVAFPQWGD**QVTDAKYLVDVFKVGVRMCRGEAENKLIT
RDVVEQCLREATSGPKAEEMKQNAMKWSAAAEAAVAEGGSSDRNIQAFVD
EVKRRSLEVLAVSGKSTANGVAELGEPKVNGELKVVS

Figure 129: Amino Acid sequence of SeqID 409. The conserved UDP-glucoronosyl/UDP-glucosyl transferase family domain is underlined and the UDP-glycosyltransferases signature is in bold.

MGSEAL<u>VHVLLVSFPGQGHVNPLLRLGKRLASKGLLVTFTTPESIGKAMRKA</u>
<u>SNIGEELSPVGDGFIRFEFFEDGWDEDEIRRQDLDQYLPQLEKVGKVLIPEMI</u>
<u>RRNAEQGRPISCLINNPFIPWVSDVADSLGLPSAMLWVQSCACFTSYYYYY</u>
<u>HGLVPFPSETAMEIDVQLPCMPLLKHDEVPSFLYPTTPYPFLRRAIMGQYKN</u>
<u>LDKPFCILMDTFQELEHEIIEYMSKISPIKTVGPLFKNPKAPNATVKGDFMKAD</u>
<u>DCVGWLDSKPASSIVYVSFGSVVYLKQDQWDEIAYGLLNSGVNFLWVMKPP</u>
<u>HKDSGYEVLKMPEGFLEKAGDRGKVVQWSPQEQVLAHPSVACFVTHCGW</u>
<u>NSTMEALTSGMPVVAFPQWGDQVTDAKYLVDVFKVGVRMCRGEAENKLIT</u>
<u>RDVVEQCLREATSGPKAEEMKQNAMKWSAAAEAAVAEGGSSDRNIQAFVD</u>
<u>EVKRRS</u>LEVLAVSGKSTANGVAELGEPKVNGELKVVS

Figure 130: Amino Acid sequence of SeqID 410. The conserved UDP-glucoronosyl/UDP-glucosyl transferase family domain is underlined MAQAEEKREENHVLLVAFSSQGHINPMLRLGKRLAARGIHVSLATTEIVRHR
MLKSSGAGPADHVTGIELLFFSDGLSLDYDRKTNLDVYMDILGKQGPSNLSA
LIKEHYTSPKKLLCLVTNPFVPWVSDVAAEYNIPCAMLWIQPCALYAIYYRCF
NKLSAFPTLTDPDMVVELPGLPSMEKEDLPSFVLPNNPFGSFPKLFSELFQG
MEKFKWVLGNSFYELEKHVIDSMCELYPIRPIGPLVPPTLLGQDQELEDASV
DMWKSDDTCIEWLTQQPPSSVIYVSFGSIVVLPAKQMEAIAMALKNVKRPFL
WVVKPPEFPTPDGAGQLPSWFLEETKDQGQVVRWSPQTRVLSHPAVACFI
THCGWNSMLETICSGIPLIAYPQWTDQPTNAKLIVDVFKIGVRIKKEADGNIR
GEVIEKCIEEVMVGPVAEQLRKNAMALKAEAQKAVAAGGSSDENIRLFVEEI
TGDSCKKDGSPNVGNLSHEVQDKVSDKGV Figure 131: Amino Acid sequence of SeqID 411. The conserved UDP-glucoronosyl/UDP-glucosyl transferase family domain is underlined and the UDP-glycosyltransferases signature is in bold.

MAPP<u>HFLLVTFPGQGHINPSLQFAKRLVRVGAHVTFATAIRARPRMAESESI
PEGLSFASFSDGYDDGFDNWDEMEEYMDKIKRRGTETLSDLIASNLKSGRR
FSGVLYTILLPWAAEVARSHGIPSTFVWIQPATVLDFYYYYFHGYGDLIRSTG
GNPSVPIQLPGLPPLMACDIPSFFNSKNEYNFSLPLFQWHFKILLEEAKPRIL
ANTFDALEPDAIRAINEFEVIGIGPLIPSAFLDGQDPSDTSFGGDLFKSSSGY
MEWLDTKPKASVIYVSFGSISVLSKPQKEEMARALVEAGRPFLWVIRESGKE
ERDEDRLSFKEELDKIGMIVP**WCSQVEVLSHPSVACFVTHCGWNSTSESLV
CGVPMVAFPQWSDQ**QTNAKLVADVWRTGVRITPNEQGLVESGEMRRCLE
LVMGDGKEGEEMRRNARKFRDLAREAVKEGGSSDKNLRAFVDEVREASEL
E</u>

Figure 132: Amino Acid sequence of SeqID 412. The conserved UDP-glucoronosyl/UDP-glucosyl transferase family domain is underlined.

MDENRKRDWNRHLVLVPCPLQGHLNPMLSLASVFHSKGFGVTLVLVQTSS
HPAATSWASDDFFYESLGGSDGSISNAPDVDLMRFLNEVNLKCKSSFRDCL
MGLRMGRLRDRKLCVVYDAIMYFSAEVSDELEIPRMVLRTSIVANFLGLSML
SQKAYLPAQEDGAVKAIQELIPSMRARDMPVFDKSCPEATERVLAQIHESTS
TASAIVWNTLQTLEQALLHRLQSSLSPPIFPIGPLHKYRTRDPRRRHHRSLFA
VETGARREEDRIKCVSFLDSHPPGSVVYVSTGSLVKLSRSELAEMARGLAD
CGQPFLWAVELSSAHDGDIAQLIPRGEELLCAAADCHPNAPSMRGLVVAWA
PQEEVLAHGSIGCFWTHNGWNSTLESMTEGVPMLCWPRVGDQKIIAGFVT
RVWRVGLELECDGNGGLERGRISRSIKRLMAGEEGREIRKRALEMEETVEL
ALSDGGCSSQSLSKLVDFIQLL

Figure 133: Amino Acid sequence of SeqID 413. The conserved multicopper oxidase, type 1, family domain is underlined and the multicopper oxidases signature 2 is in bold.

MAPSPSTAFSIRLLAFALPFALLLGNAVLRA<u>QASVHYYDFVLRETNITRNCTS</u>
<u>WRLLLVNDSFPGPTIEVHKGDLVFVNVHNQGDYGVTLHWHGVKQPRNPWS</u>
<u>DGPEYITQCPIPPGTNFTYEVNFTTEEGTLWWHAHSVWTRATVHGAIVILPE</u>
<u>EGTTYPFPKPDGEEIIVLGSWYSEGDDLNSGVGVSLETGEAMPESIGYMING</u>
<u>EFGDFVACSQDSTYHMYVEYGKTYLLRIINAVVGAELFFAIADHNLTVVGMD</u>
<u>ASYTGPLVSPYLTTSPGSTLDVIFTANKTPGRYYMAVRRYTSQDTDVTDFNH</u>
<u>MVATAILHYSGNYSLDTSPKFPNRSLPGYYDYSGADTFTFKLRGLASKEHPS</u>
<u>DVPLNITRRMFITLSMNEILCPHHDCIVAPTTLGSSLNNQSWDDPSTDVLQAY</u>
<u>YKNISGVYTADFPDFPPFAYNWTGADNPDAWGVANKVTRVKMLEYNESVE</u>
<u>VVFQDSGVLQGAQRHPMHMHGYSFYVVGHGLGNFDNETDPLEYNLLDPPL</u>
<u>VNTFSVPRDGWIAIRFANNPGVWFWHCHIDKHMSWGMDTVFIVKDGGTE</u>
ETSMRGPPSYMPPCEDSYNIARMKSRRLPRQISRI

Figure 134: Amino Acid sequence of SeqID 414. The conserved multicopper oxidase, type 1, family domain is underlined and the multicopper oxidases signature 2 is in bold.

MGTFLGFVVTMTLLFCMAQGEVI<u>YYDFVVKETPIQMLCGTNQTVLTVNGLFP</u>
<u>GPEIHAHKGDTIYVNVTNTGPYGVTIHWHGVRQIRYPWSDGPEYITQCPIPT</u>
<u>NSSFLQKIILTEEEGTLWWHAHSDWTRATIHGPIIILPVNGTNYPYKFDEQHTI</u>
<u>VISEWYARDTKDIIDEALATGGDPDLSVAYTINGQPGDSYSCSNDSTYNLTA</u>
<u>VQGKTYLLRIIHSGLNEEMFFGIADHNITVVGMDGAYLKPLNTEYLMITPGQT</u>
<u>MDVLVTANQTPGRYYMVFSPFVDTNAPSNDNVTRGIFQYTGTYNQSETPVL</u>
<u>PELPGLTNKSDAGNFTIQLRSLNSAEHPSTVPTNITRNITITVSVNQQPCPAN</u>
<u>QTCNGPDGSMHSASLNNISFSAPSISILQAYYNNLQGVYNKTFPDTPPFVFD</u>
<u>YTGNVSALGEAANVTTEVLMINHNEEVEIRFQGTNLGAAENHPMHLHGYSF</u>
<u>YVVGMGDGNFSDSYVSQYNTVDPPFVNTVGLPKNGWTAIRFKADNPGVWF</u>
<u>MHCHLERHASWGMDTVIVVKDGP</u>NDDQKVLPPPDDVPPCS

Figure 135: Amino Acid sequence of SeqID 415. The conserved multicopper oxidase, type 1, family domain is underlined and the multicopper oxidases signature 2 is in bold.

MGTFLGFAVTATLLFCMAQGEVL<u>FYDFVVNETPIEMLCETNRSVLIVNGLFP
GPEIRAHKGDTIYVNVTNLGPYGITIHWHGVRQIRYPWSDGPEYVTQCPIPT
NSSFLQKIKLTEEEGTLWWHAHSDWSRATIHGPIIILPVNDTNYPYKFDEQHT
IVISEWYARDTKDIIDEALESGGDPDLSVAYTINGQPGDSYSCSNGSAYNITV
VQGKTYLLRIIHSGLNEEMFFGIAEHNLTVVGMDGAYLKPLNIEYLMITPGQT
MDVLVTANQILGRYYMVFSPFVDTSAPSNENVTRGIFQYNGTYNHSETPVLP
ELPGFTNKSDAGNFTIQLRSLNSEEHPSTVPTNITRNITITVSVNQQPCPANQ
TCTGPDGSMHSASLNNISFLAPSISILQAYYNNLLGVYNETFPDEPSFVFDYT
GNVSALGEAAIVGKEVLMINYNEEVEIRFQGTNLGAAENHPMHLHGYSFYVV
GMGDGNFSDSYVSDYNLVDPPYVNTVGLPKNGWTSIRFKADNPGVWFMH
CHLERHASWGMNTVFIVGDGK</u>EKHQKVYPPPSYMPPCTVS

Figure 136: Amino Acid sequence of SeqID 416. The conserved multicopper oxidase, type 1, family domain is underlined and the multicopper oxidases signature 2 is in bold.

MGTFLGFAVTATLLFCMAQGEVL<u>FYDFVVNETPIEMLCETNRSVLIVNGLFP</u>
<u>GPEIRAHKGDTIYVNVTNLGPYGITIHWHGVRQIRYPWSDGPEYVTQCPIPT</u>
<u>NSSFLQKIKLTEEEGTLWWHAHSDWSRATIHGPIIILPVNDTNYPYKFDEQHT</u>
<u>IVISEWYARDTKDIIDEALESGGDPDLSVAYTINGQPGDSYSCSNGSAYNITV</u>
<u>VQGKTYLLRIIHSGLNEEMFFGIAEHNLTVVGMDGAYLKPLNIEYLMITPGQT</u>
<u>MDVLVTANQILGRYYMVFSPFVDTSAPSNENVTRGIFQYNGTYNHSETPVLP</u>
<u>ELPGFTNKSDAGNFTIQLRSLNSEEHPSTVPTNITRNITITVSVNQQPCPANQ</u>
<u>TCTGPDGSMHSASLNNISFLAPSISILQAYYNNLLGVYNETFPDEPSFVFDYT</u>
<u>GNVSALGEAAIVGKEVLMINYNEEVEIRFQGTNLGAAENHPMHLHGYSFYVV</u>
<u>GMGDGNFSDSYVSDYNLVDPPYVNTVGLPKNGWTSIRFKADNPGVWFMH</u>
<u>CHLERHASWGMNTVFIVGDGKEKHQKVYPPPSYMPPCTVS</u>

Figure 137: Amino Acid sequence of SeqID 417. The conserved multicopper oxidase, type 1, family domain is underlined and the conserved domains are in bold MESCWVRLLVLLFGVLVLPAMV<u>ECRVRHYKFNVVMKNMTRLCSTKPIVTVN</u>
<u>GKLPGPTLYAREGDNVLVKVANHVKYNVTIHWHGVRQLRTGWADGPAYIT</u>
<u>QCPIQTGQNFIYNFTITGQRGTLLWHAHILWLRVTLHGAIVILPKRGVPYPFP</u>
<u>KPSKEYVIILAEWWKADTETVINQAMSQGLAPNVSDAHTINGHPGPVPGCP</u>
<u>SERSYTLPVESGKTYLLRIVNAALNEELFFKIAQHNLTVVEVDATYVKPFQT</u>
<u>DTILITPGQTTNVLLTTNQNAGKYLITASTFMETAIVAIDNVTASAAVHYSGTL</u>
<u>ASASTVLTKPPPQNASAVANSFNNALRSLNSKKYPAKVPKTVDHNLFFTMGL</u>
<u>GVNPCPTCTAGNGSRVVAAVNNISFVMPTIALLQAHVFNISGVFTTDFPGNP</u>
<u>PTTYNYTATPPQNASVPTMNGTKVYRLPYNATVQLVLQDTGIIAPETHPIHL</u>
<u>HGFNFFGVGKGVGNYDPKKDPKKFNLVDPVERNTIGIPSGGWIAIRFTADN</u>
<u>PGVWFLHCHLEVHTTWGLKMAFLVDNGK</u>GPKETLLPPPSDLPKC Figure 138: Amino Acid sequence of SeqID 418. The conserved multicopper oxidase, type 1, family domain is underlined and the conserved domains are in bold MESCWVRLLVLLFGVLVLPAMV<u>ECRVRHYKFNVVMKNMTRLCSTKPIVTVN</u>
<u>GKLPGPTLYAREGDNVLVKVANHVKYNVTIHWHGVRQLRTGWADGPAYIT</u>
<u>QCPIQTGQNFIYNFTITGQRGTLLWHAHILWLRVTLHGAIVILPKRGVPYPFP</u>
<u>KPSKEYVIILAEWWKADTETVINQAMSQGLAPNVSDAHTINGHPGPVPGCP</u>
<u>SERSYTLPVESGKTYLLRIVNAALNEELFFKIAQHNLTVVEVDATYVKPFQT</u>
<u>DTILITPGQTTNVLLTTNQNAGKYLITASTFMETAIVAIDNVTASAAVHYSGTL</u>
<u>ASASTVLTKPPPQNASAVANSFNNALRSLNSKKYPAKVPKTVDHNLFFTMGL</u>
<u>GVNPCPTCTAGNGSRVVAAVNNISFVMPTIALLQAHVFNISGVFTTDFPGNP</u>
<u>PTTYNYTATPPQNASVPTMNGTKVYRLPYNATVQLVLQDTGIIAPETHPIHL</u>
<u>HGFNFFGVGKGVGNYDPKKDPKKFNLVDPVERNTIGIPSGGWIAIRFTADN</u>
<u>PGVWFLHCHLEVHTTWGLKMAFLVDNGK</u>GPKETLLPPPSDLPKC Figure 139: Amino Acid sequence of SeqID 419. The conserved multicopper oxidase, type 1, family domain is underlined and the multicopper oxidases signature 2 is in bold.

MDSWLQILVLVACIT<u>PAVVQGRVRNYTFNVVMKNTTRLCSSKPIVTVNGMFP</u>
<u>GPTLYAREDDTVLVRVSNRVKYNVTIHWHGIRQLRSGWADGPAYITQCPIQP</u>
<u>GQSYVYNFTITGQRGTLLWHAHILWLRATLHGAIVILPKRGVPYPFPKPHKEV</u>
<u>VVVLGEWWKSDTEAVIKQAIKSGLAPNVSDAHTINGHPGPISNCPSQGGFTL</u>
<u>PVESGKRYMLRIVNAALNEELFFKIAGHQLTIVEVDATYVKPFKTDTIVIAPGQ</u>
<u>TTNALISADQSSGKYLVAASPFMDSPITVDNMTATATLHYSGTLAATSTTLTK</u>
<u>TPPQNATAVANNFINSLRSLNSKIYPAKVPLTVDHNLLFTVGLGINPCPSCKA</u>
<u>GNGSRVVASMNNVTFVMPTTALLQAHFFNISGVFTSDFPGNPPTTFNYTGS</u>
<u>PPTNLRTTSGTKVYRLRYNSTVQLVLQDTGIIAPENHPIHLHGFNFFAVGKGL</u>
<u>GNYNPKVDQKNFNLVDPVERNTIGVPSGGWVAIRFRADNPGVWFMHCHLE</u>
<u>IHTTWGLKMAFLVDNGKGPNESLLPPPSDLPKC</u>

Figure 140: Amino Acid sequence of SeqID 420. The conserved multicopper oxidase, type 1, family domain is underlined and the multicopper oxidases signature 2 is in bold.

MDSWLQILVLVACIT<u>PAVVQGRVRNYTFNVVMKNTTRLCSSKPIVTVNGMFP
GPTLYAREDDTVLVRVSNRVKYNVTIHWHGIRQLRSGWADGPAYITQCPIQP
GQSYVYNFTITGQRGTLLWHAHILWLRATLHGAIVILPKRGVPYPFPKPHKEV
VVVLGEWWKSDTEAVIKQAIKSGLAPNVSDAHTINGHPGPISNCPSQGGFTL
PVESGKRYMLRIVNAALNEELFFKIAGHQLTIVEVDATYVKPFKTDTIVIAPGQ
TTNALISADQSSGKYLVAASPFMDSPITVDNMTATATLHYSGTLAATSTTLTK
TPPQNATAVANNFINSLRSLNSKIYPAKVPLTVDHNLLFTVGLGINPCPSCKA
GNGSRVVASMNNVTFVMPTTALLQAHFFNISGVFTSDFPGNPPTTFNYTGS
PPTNLRTTSGTKVYRLRYNSTVQLVLQDTGIIAPENHPIHLHGFNFFAVGKGL
GNYNPKVDQKNFNLVDPVERNTIGVPSGGWVAIRFRADNPGVWF**MHCHLE
IHTTWGL**KMAFLVDNGKGPNESLLPPPSDLPKC</u>

Figure 141: Amino Acid sequence of SeqID 421. The conserved multicopper oxidase, type 1, family domain is underlined and the conserved domains are in bold MDSWLQILVLVACITPAVVQGRVRNYTFNVVMKNTTRLCSSKPIVTVNGMF
PGPTLYAREDDTVLVRVSNRVKYNVTIHWHGIRQLRSGWADGPAYITQCPI
QPGQSYVYNFTITGQRGTLLWHAHILWLRATLHGAIVILPKRGVPYPFPKPH
KEVVVVLGEWWKSDTEAVIKQAIKSGLAPNVSDAHTINGHPGPISNCPSQG
GFTLPVESGKRYMLRIVNAALNEELFFKIAGHQLTIVEVDATYVKPFKTDTIV
IAPGQTTNALISADQSSGKYLVAASPFMDSPITVDNMTATATLHYSGTLAAT
STTLTKTPPQNATAVANNFINSLRSLNSKIYPAKVPLTVDHNLLFTVGLGINPC
PSCKAGNGSRVVASMNNVTFVMPTTALLQAHFFNISGVFTSDFPGNPPTTF
NYTGSPPTNLRTTSGTKVYRLRYNSTVQLVLQDTGIIAPENHPIHLHGFNFF
AVGKGLGNYNPKVDQKNFSLVDPVERNTIGVPSGGWVAIRFRADNPGVWF
MHCHLEIHTTWGLKMAFLVDNGKGPNESLLPPPSDLPKC Figure 142: Amino Acid sequence of SeqID 422. The conserved multicopper oxidase, type 1, family domains are underlined MRSLFLSALLLAVMSCFLPEVAHAGITRHYTFNIEMHSETRLCHTKRMITVNG
KFPGPRIVAREGDRVIVKVVNHVSSNISIHWHGIRQLQGGWADGPSYITQCPI
QTNQSYVYNFTITGQRGTLFWHAHISWLRATVYGPLIIFPKRGVPYPFAKPD
KEVPMLFGEWFNADTEAIISQALQTGGGPNVSDAYTINGKPGPLYNCSSDTF
KLKVTPGKTYLLRLINAALNDELFFRIANHSFTVVEADAVYVKPFKTDILVIAP
GQTTNVLLKAKPNPHKSTYLMAARPYFTGQGTFDNTTMAGFLEYVQSSGNI
TLPKNLTLSLPTLPAINATSVVANFSQKFRHLNSRQYPAQVPQTVQKRFFFT
VGLGNSPCSKNQTCQGPNGTKFAASVNNVSFALPSTALLQSYFFKKSNGVF
TTDFPATPLRPFNYTGTPPNKTFVSNGTKVVVLPFNTSVELVMQGTSILGAE
SHPLHLHGFNFYVVGQGFGNFNQSTDPAKFNLVDPVERNTVGVPAAGWVA
IRFLADNPGVWFMHCHFDVHLSWGLKMAWIVQDGKLPNQKLPPPPSDLPK
C Figure 143: Amino Acid sequence of SeqID 423. The conserved multicopper oxidase, type 1, family domain is underlined and the conserved domains are in bold MSFQNQLFIFCTLLLGFLK<u>LAEGKTRHYTFHIDSHNMTRLCHTRSVLSVNKQ</u>
<u>YPGPPLVAREGDNILVKVVNHVAANVTIHWHGVRQLRTGWADGPAYVTQC</u>
<u>PIQTNQSYTYNFTLTGQRGTLLWHAHVSWLRSSIHGPIIILPKRNESYPFEKP</u>
<u>SKEVPIIFGEWFNVDPEAVIAQALQSGGGPNVSDAYTINGLPGPLYNCSSK</u>
<u>DTFKLKVKPGKTYLLRLINAALNDELFFSIANHTVTVVEVDAVYTKPFSAGC</u>
<u>LHLTPGQTMNVLLKTKTDFPNSTFLMAAWPYFTGMGTFDNSTVAGILEYEH</u>
<u>PKSSNYPPLKKLPQYKPTLPPMNSTGFVAKFTGQLRSLASAKFPANVPQKV</u>
<u>DRKFFFTVGLGTSPCPKNTTCQGPNGTKFAASVNNISFVLPSVALLQAHFFG</u>
<u>QSNGVYTTDFPTNPPVQFNYTGTPPNNTMVTNGTKTVVLAYNTSVELVMQ</u>
<u>DTSILGTESHALHLHGFNFFVVGQGSGNYNPNKDPTKFNLVDPIERNTFGV</u>
<u>PSGGWVAIRFLADNPGVWFMHCHLDVHTSWGLKMAWIVLDGP</u>QPNQKLP
PPPSDLPKC Figure 144: Amino Acid sequence of SeqID 424. The conserved multicopper oxidase, type 1, family domains are underlined and the multicopper oxidases signature 2 is in bold.

MRTGGAGNKMALIAALLGFVFLEYGSLLCMA<u>RGNVHHYDFVLKETNFTRLC
TTKSMLVVNESWPGPVIRVHKGDTVFVTVHNKGTYGVTVHWHGVKQPRNP
WPDGPENITQCPIPAGTSFTQELSFSDEEGTLWWHAHSDWSRATVHGAIII
PKPGTTYPYPMPYKEELLVLGEWYNGDVMAIIDEALETGGDPNVSDAFAING
QPGDLYDCSNASTYRLLVNYGKTYLLRIVNAVMNEEIFFGIAKHNLTVVGMD
GAYLKPIKTDYIMITPGQTMDVLVTANQSPSHYYIMGSPFADTTAPFDNTSTT
AIFQYSGN</u>YTPPSTPYSPSLPAYDDKDAAGNFTVRLKSLASKQHPISVPLKIT
ERIFMTVSVNQIYCANESCDGPDGNRLSASLN<u>NISFVTPTIDILQAYYRHIHGV
YNSTFPSIPPYFFNFTGDVGNNTIYPSQGTKVKMIKYGSVVEIIFQGTNVGAA
ENHPMHLGYSFYVVGVGNGNFDNKTSPKTYNLVDPPLVNTIGLPKNGWTT
IRFVADNPGVWFMHCHLERHASWGMDTVLIVTDGL</u>ANTNKMRGQPAYMPP
CAKS

Figure 145: Amino Acid sequence of SeqID 425. The conserved multicopper oxidase, type 1, family domains are underlined.

MGSSPCELRWLLALLGGLLLVLPLAQGEDHYYTFVLRDTNFTRLCTTKSMFT
VNESFPGPVMYVRKGDTAYVNVFNEGHYGVTIHWHGIKNPRNPWFDGPEY
VTQCPIPPGTNFTYQVLFTSEEGTLWWHAHSDWTRATVHGAIVIKPALGTTY
<u>PFPEPDDEKVLVFASWYDEDVMELMEEALSEGGLTTLSDAYCINGQPGDFY</u>
<u>NCSRENTTRISVDYGKTYLLRLINSVQNTDMYFGIANHSLTVVGWDGAYVKP</u>
<u>FVMSYIMITPGQAMDILVTADQPLGEYYIILSPYFDGQADDFDMSIASAIFQYN</u>
<u>GNYSYTGLPAYPSDFPGWEDIGPATDFVKQLRSLNSLEHPIDVPQDDEITTR</u>
MYITISISMMKCPNASCEGPDGNRLASALNNISFANPDLDVLQAYYSNITGYY
TPD<u>FPDLPPTLFNFTSEDLLTDNVTMSDQGTRVKVLNYNESVEIILQGTNVM</u>
<u>NSGETHPMHLHGFRFYVIGMGQGNFDNKTAPETYNMYDPPEANTVPVPKD</u>
<u>GWAVIRFRADNPGVWYMHCHFDRHMAWGMDTVFIVKNGT</u>TAETSIREPPA
YMPPCETDSSLLSALHSYLRQKA

Figure 146: Amino Acid sequence of SeqID 426. The conserved multicopper oxidase, type 1, family domains are underlined,The multicopper oxidases signature 1 is in bold and the multicopper oxidases signature 2 is in bold/italics.

MEMRCSGGVQILQILGLVLVLGIPNCEAVLRHKFVIKETNYTRLCSTKSILTVN
GQFPGPTLYAHKGDTVIVDVYNKANYNVTIHWHGVKQPRNPWHDGPEYITQ
CPIKPGGKFTQNVTFSLEEGTLWWHAHSDWTRATVHGAIIVYPKKSTSYAFA
KPHTEVPIILGEWWKQDIVDIYDEFLQSGGDPNISDAYLINGQPGDLYPCSKQ
DTFKLVVEYGKSYLLRVINAALQDILFFAIAGHQVTVVGTDASYTKPLKVDYITI
SPGQTIDLLLEANQPKDHYYMAARVYSSATGVEFDNTTTTALIQYKGRYTPS
SPPPLPYLPYYNDTAASVNFTGRLRSLASGEHPVPITVPQTVTHKFLFTVSV
NTFPCVNDSCAGPNGSRLAASVNNISFVSPSISILQAYYYHIKGVFGTRFPSK
PPLEFNYTADYLPLAVRTPRNGTEVKVLKYNATVEMVFQGTNVVAGTDHPM
HLHGTSFYVVGWGFGNFDKKKDPKKYNLVDPPLQNTIAVPKNGWAAVRFQ
AFNPGVWFM*HCHLERHLSWGM*EMAFIVKDGPTSESQMLPPPPGMPPC

Figure 147: Amino Acid sequence of SeqID 427. The conserved multicopper oxidase, type 1, family domain is underlined.

MAVCATKLLVSAFVVVGLLLLLSASIVHGDVHYHDFVLKEKNYTRLCSTKSM
LVVNDSFPGPTIYVKKGDTLYVNVHNQGAYGVTIHWHGVNQPRNPWFDGA
EYVTQCSISPGTNFTYQVLFTEEEGSLWWHAHSEWARYSIHGFIVIHPADGT
SY<u>PFPQPDGEKEMVLASWYTEDVYASIAEKLAAGSDLLVSEAYTINGEPGDF
CECSNETTHRWMVDYGKTYLLRLLNADMNAELFFAIADHNVTVVGSDAAYL
KPFSSEIVFISPGQTIDVLVTANQPPGRYYIAARQYYSNQFKFSEYDHANATA
ILEYSGN</u>YTAPSTPVFPSGLPSYTNYKAATGFVQSMRNIIDHVNVPMNITTRM
YITVSLNKFTLEINDTTEESYPSASLNNISWYNPWTDVLQAYYRNISGFYTTD
FPEFPPTFFNFTQHNLPLNTTNEPERGTKVKVLEYNEEVEIVFQNTDVANSS
ENHPMHLHGHSFYVLGTGFGNYNNETDPLTFNLIDPPYQNTASVPKDGWLA
IRFRASNPG

Figure 148: Amino Acid sequence of SeqID 428. The conserved multicopper oxidase, type 1, family domains are underlined and the multicopper oxidases signature 2 is in bold.

MGTFLGFAVTATLLFCMAQGKVL<u>FYDFVVNETPIEMLCETNRSVITVNGLFP
GPEIRAHKGDTIYVNVTNLGPYGITIHWHGVRQIRYPWSDGPEYVTQCPIPT
NSSFLQKIKLTEEEGTLWWHAHSDWSRATIHGPIIILPANDTNYPYEFDDQHT
IVISEWYARDTKDIIDEALASGGDPDLSVAYTINGQPGDSYSCSNGSAYNITV
VQGKTYLLRIIHSGLNEEMFFGIAEHNLTVVGMDGAYLKPLNTEYLMITPGQT
MDVLVTANQALGRYYMVFSPFVDTTAPSNENVTRGIFQYNGTYNHSETPVL
PELPGFTNKSDAGNFTIQLRSLNSEEHPSTVPANITRNITITVSVNQQPCPAN
QTCTGPDGSMHSASLNNI</u>SFSAPSISIL<u>QAYYNNLLGVYNETFPDEPPFMFD
YTGNVSALGEAANVSTEVLMINYNEEVEIRFQGTNLGAAENHPMHLHGYSF
YVVGMGDGNFSDSYVSDYNLVDPPYVNTVGLPKNGWTSIRFKADNPGVWF
MHCHLERHASWGMDTVLIVGDGKL</u>KHQKVYPPPSYMPPCTVS

Figure 149: Amino Acid sequence of SeqID 429. The conserved multicopper oxidase, type 1, family domains are underlined and the multicopper oxidases signature 2 is in bold.

MGRDREKKKRTIIRNMANSTSPTSYIYFVAISLFLGNLVLGAQA<u>RTVHYYDFV
LREINVTRNCTITTILVVNDSFPGPTIRVQKGDLVYVKVHNQGLYGVTLHWHG
VKQPRNPWSDGPEYITQCAIPPGTNFTYEVNLTEEEGTIWWHAHNEWTRST
VHGAIVVLPREGSSFPFPTADGEHVIVLGSWYNEGTSLNKALEMEMSIGSPN
IPRATGYLINGQYGDFVPCSNETTPHFFVDYGKTYLLRIVSAVVGTEMFFSIA
DHNMTVVGMDGAYTKPIVVSYLMIEPGQTMDILVTTNQSPGRYYMAAQRFA
TEYLAFTKFSHVVATAIIQYKGNYSLTSPPSFPIDTLPFYHDYSAAVSFTHQLR
SLATEEYPVDVPYNVTTRMFITASLNSLPCPDDSCYMGDSKLAASLNNISWK
DPSVDVLQAYYRNISGVYTADFPDFPPEMFNFTGDDLPSSLAEASVGTAVK
VLNYNETVEIVFQGTNLLEGSEYHPMHMHGYSFYIVGLGSGNFNNETDPLA
YNLVDPPKVNTFGVPRSGVVAIRFRADNPGVWFWHCHIDRHMSWGMDYV
FIVKNGDTEETSMRPPPPYMPPCVASKKDKLFGEQDRNLKSDI</u>

Figure 150: Amino Acid sequence of SeqID 430. The conserved cytochrome P450 family domain is underlined.

MGVQLIVALICALVIPLLAVFFIDTKKKTRAFRNLPPGPRKLPIIGNLHQLGSLP
HRSLARLSKQYGQIMLLHLGSIPTLVISSEDVAREVFKDHDTAFSGRPIFYAG
KKLAYNQSDITFSTYGESWKELKKLVTQELLNNKRVKSFESVRKDEVKLMLD
AITSSPGPVNIGELSLLLSNNIVCRVAFGSKYQADGSSVKSKFHETIRGIQKIL
GGFCVADLFPYMAWFNRLNGFNAKVEKNFMELDKFYDEVIEQHQDPQRPK
LDHEDLVDVLLRLQRDPNQMNALTREQFKGVLTNIFNAGTGTSATTILWAMA
ELVRNPAVMRKAQEEVREVAKGKLHVEETDLLGLTYLRSVIKETLRLHPPLP
LLVPRATIEDCKIRGYTVPRGTTVFVNVQAIATDPKSWENPEEFRPGRFLNS
SIDFTGQNYEYLPFGSGRRGCPGRNFGVVIVELALANLLHRFDWKLPKGMS
VEDIDMEEAYGLSTHKRTPLCLIATPMTG

Figure 151: Amino Acid sequence of SeqID 431. The conserved cytochrome P450 family domain is underlined.

MDYLVLILCLHLLWGLIQVLSFVAARIKKAPSNLPPGPRPLPLIGNLLELGKLP
HQSLARLARTYGPIMKLQLGFVTTVVISSPTLAKEILQTHDALFLNRTIPDTITA
HNHDQFGLPWIPISPLFRNLRKMYNSHLLSNKKLDSNQYLRKKKVEELVCYV
QKCAQNGDVIDIGEAAFTTSLNSLSNTVFSLDMTYPSNSAKELKEVVGQIMA
EAGKPNLADYFPVLKKIDPQGLKQRMELYFGKMFDVFDVLIKKRWQQRMQS
GSVASNDVLDALLDVMEEKSEDMDISLVKHLFLDFFVAGTETTSSTLEWAMA
ELLCNSEKLSKAQTELHEVIGKGNQMEEVDVPRLPYLQAIVKETFRLHPPFP
LLLPRKSEADTQIGGFTIPKGAQVLINAWAIGRDPSIWVNPNEFVPERFLGSD
IDLRGKNFELVPFGGGRRICPGLPLAARMLHLMLGSLINSFNWKLEDGVTPE
NMNMEDKFGISMQRAQPLKAVALPA

Figure 152: Amino Acid sequence of SeqID 432. The conserved cytochrome P450 family domain is underlined and the E-class P450, group I domain is in bold.

MAWIWITLSFTLIAHLLLRALPWKRKSKKKLPPGPIGYPILGNLPLLGQNPHH
DLHKLAQKYGPLMYLRLGFVHTIVVSSPELAEQFLKTHDLVFASRPPHEASK
HISYEQRSLAFAPYGPYWRNIRKMCTLELLSNAKINSFKSMRREEVGLLVNF
LKDAAHDHTAIDLSSKIFSLSADMSCRMVFGKKYMDKEFDERGFKAVIQEGM
VLGATPNIGDYVPYLARFDLQGLTKRMKAVSKVFDAFFEKIIDEHMKSMKEE
GESKDFVDVMLGFMGLNEGEYHIDRPHIKAIILDMLSGSMDTSATAI**DWAMT
ELVRHPSAMKRVQDELEKAVG**MNRAVEESDLEGLHYLDMVIKETMRLHPV
APLLLPHEATEDCTVNGFHIPLKSRVIVNVWSIGRDPKVWTTHDPEEFIPERF
LGSSMDVKGRDFQLLPFGAGRRGCPGMQLGLTVVRFVLAQLVHCFDWDLP
AGISPSELDMTEEFGLTAPRAKHLVVMPRYRLSE

Figure 153: Amino Acid sequence of SeqID 433. The conserved cytochrome P450 family domain is underlined MALHILFTWLALSLPLLLLLLLSVKNFNNKKKNLPPGPPSLPIIGNFHQLGPMP
HQSLWKLSRRYGPVMLIRLGGTPTIVISSPDAAREVLKTHDLDSCSRPQMVG
TGRLSYDSLDVAFVEYGDYWRELRTLCVLELFSMKRVQSFRYIREEEVGSMI
ESIAKSAESGTPVNMSEKFMALTANFTCRVAFGKPFQGTELEDEGFMDMVH
EGMAMLGSFSASDYFPRLGWIVDRFTGLHSRLEKSFRNLDDLYQKVIEEHR
NANKSNEGKEDIVDVLLKMEKDQTELAGVRLKEDNIKAILMNIFLGGVDTGAV
VMDWTMAELARNPRVMRKAREEIRSCVGNKKWVVEEDLSGLKYLKLVLKE
VMRLHPPGVLLIPRETIGHFKLSGYDVDPKSCVYVNAWGMGRDPGLWERP
EEFVPERFEDSPIDYKGNHFELIPFGAGRRRCPGMSMVMAMIELALANVLHS
FDWELPEGMTEGDVNMEEGAGLAVFKKVPLTLLPIKASHKIDA Figure 154: Amino Acid sequence of SeqID 434. The conserved cytochrome P450 family domain is underlined MALHILFTWLALSLPLLLLLLLSVKNFNNKKKNLPPGPPSLPIIGNFHQLGPMP
HQSLWKLSRRYGPVMLIRLGGTPTIVISSPDAAREVLKTHDLDSCSRPQMVG
TGRLSYDSLDVAFVEYGDYWRELRTLCVLELFSMKRVQSFRYIREEEVGSMI
ESIAKSAESGTPVNMSEKFMALTANFTCRVAFGKPFQGTELEDEGFMDMVH
EGMAMLGSFSASDYFPRLGWIVDRFTGLHSRLEKSFRNLDDLYQKVIEEHR
NANKSNEGKEDIVDVLLKMEKDQTELAGVRLKEDNIKAILMNIFLGGVDTGAV
VMDWTMAELARNPRVMRKAREEIRSCVGNKKWVVEEDLSGLKYLKLVLKE
VMRLHPPGVLLIPRETIGHFKLSGYDVDPKSCVYVNAWGMGRDPGLWERP
EEFVPERFEDSPIDYKGNHFELIPFGAGRRRCPGMSMVMAMIELALANVLHS
FDWELPEGMTEGDVNMEEGAGLAVFKKVPLTLLPIKASHKIDA Figure 155: Amino Acid sequence of SeqID 435. The conserved cytochrome P450 family domain is underlined MALHILFTWLALSLPLLLLLLLSVKNFNNKKKNLPPGPPSLPIIGNFHQLGPMP
HQSLWKLSRRYGPVMLIRLGGTPTIVISSPDAAREVLKTHDLDSCSRPQMVG
TGRLSYDSLDVAFVEYGDYWRELRTLCVLELFSMKRVQSFRYIREEEVGSMI
ESIAKSAESGTPVNMSEKFMALTANFTCRVAFGKPFQGTELEDEGFMDMVH
EGMAMLGSFSASDYFPRLGWIVDRFTGLHSRLEKSFRNLDDLYQKVIEEHR
NANKSNEGKEDIVDVLLKMEKDQTELAGVRLKEDNIKAILMNIFLGGVDTGAV
VMDWTMAELARNPRVMRKAREEIRSCVGNKKWVVEEDLSGLKYLKLVLKE
VMRLHPPGVLLIPRETIGHFKLSGYDVDPKSCVYVNAWGMGRDPGLWERP
EEFVPERFEDSPIDYKGNHFELIPFGAGRRRCPGMSMVMAMIELALANVLHS
FDWELPEGMTEGDVNMEEGAGLAVFKKVPLTLLPIKASHKIDA Figure 156: Amino Acid sequence of SeqID 436. The conserved cytochrome P450 family domain is underlined MALHILFTWLALSLPLLLLLLLSVKNFNNKKKNLPPGPPSLPIIGNFHQLGPMP
HQSLWKLSRRYGPVMLIRLGGTPTIVISSPDAAREVLKTHDLDSCSRPQMVG
TGRLSYDSLDVAFVEYGDYWRELRTLCVLELFSMKRVQSFRYIREEEVGSMI
ESIAKSAESGTPVNMSEKFMALTANFTCRVAFGKPFQGTELEDEGFMDMVH
EGMAMLGSFSASDYFPRLGWIVDRFTGLHSRLEKSFRNLDDLYQKVIEEHR
NANKSNEGKEDIVDVLLKMEKDQTELAGVRLKEDNIKAILMNIFLGGVDTGAV
VMDWTMAELARNPRVMRKAREEIRSCVGNKKWVVEEDLSGLKYLKLVLKE
VMRLHPPGVLLIPRETIGHFKLSGYDVDPKSCVYVNAWGMGRDPGLWERP
EEFVPERFEDSPIDYKGNHFELIPFGAGRRRCPGMSMVMAMIELALANVLHS
FDWELPEGMTEGDVNMEEGAGLAVFKKVPLTLLPIKASHKIDA Figure 157: Amino Acid sequence of SeqID 437. The conserved cytochrome P450 family domain is underlined.

MRDAMDSLLQALQNQPLPAAAAAATLVLVLLGLALLSRRRRLPYPPGPRGL
PIIGNMLMLDQMTHRGLASLARKYGGLLHLRMGFLHMVAVSSPEHARQILQL
QDHTFSNRPATIAISYLTYDRADMAFAHYGPFWRQMRKICVMRVFSRKRAE
SWRSVRDEVDKTVRAVAGSIGTVVNIGELVFALTRDITYRAAFGASATEGQD
EFIGILQEFSKLFGAFNLADFIPYLGRIDPQGINERLVKARGSLDRFIDKIMDDH
MEKKNKDKTLLSEEAETDMVDDLLAFYGEEEAKVNESEDLQNSIKLTRENIK
AIIMDVMFGGTETVASAIEWAMAELMRSPEDLKKVQKELADVVGLHRRVEE
SDFEKLTYLKCVIKETLRLHPPIPLLLHETAEDAEVSGYFIPAKTRVMINAWAI
GRDPTSWEDPDTFKPSRFLNEGAPDFKGSNFEFIPFGSGRRSCPGMQLGL
YGLEFSVANLIHSFTWELPDGQKPGEMDMSDVFGLTAPRAERLMAIPSPRLL
CPLY

Figure 158: Amino Acid sequence of SeqID 438. The conserved cytochrome P450 family domain is underlined MTLLLSVVPLLLFLGLVARLRRKPPF<u>PPGPRGLPVIGNMLMMGELTHRGLAS
LAKKYGGIFHLRMGFLHMVAVSSPDVARQVLQVHDGIFSNRPATIAISYLTYD
RADMAFAHYGPFWRQMRKLCVMKLFSRKRAESWESVRDEVDTMVRTVAG
SEGTAVNIGELVFELTRDIIYRAAFGTSSTEGQDEFISILQEFSKLFGAFNIADF
IPYLSWIDPQGLTARLVKARQSLDGFIDHIIDDHMDKKRNKTSSGGGDQDVD
TDMVDDLLAFYSDEAKVNESDDLQNSIRLTRDNIKAIIMDVMFGGTETVASAI
EWAMAELMRSPEDLKKVQQELADVVGLDRRVEESDFEKLTYLKCCLKETLR
LHPPIPLLLHETAEDAVISGYRIPARSRVMINAWAIGRDPGSWTEPDKFKPSR
FLESGMPDYKGSNFEFIPFGSGRRSCPGMQLGLYALDMAVAHLLHCFTWEL
PDGMKPSEMDMGDVFGLTAPRSTRLVAVPTPRLVGALY</u>

Figure 159: Amino Acid sequence of SeqID 439. The conserved cytochrome P450 family domain is underlined and the E-class P450, group I domains are in bold.

MALLSLILATVAISAFLYSLLGYLSRPARPL<u>PPGPRPWPLVGNLPHLGPVPHH</u>
<u>SIAALARTYGPLMHLRLGFVDVVVAASASVAAEFLKTHDTNFSSRPPNSGAK</u>
<u>HIAYNYQDPVFAPYGPRWRMLRKISSVHLFSGKALEDYRHVRQEEVAILTSA</u>
<u>LARAGSAPANLAQLLNVCTVNALGRVMLGRRMFGDGSGGGDAKADEFKSM</u>
<u>VVEVMVLAGVFNIGDFVPALEWLDLQGVAAKMKRLHKRFDAFLGAIVEEHKA</u>
<u>SMGRGGNKHNDLLSTLISLQDVADEEGGKLTDTEIKALLLNMFTAGTDTSSS</u>
<u>TTEWAIAELIRHPDILTRVQEEIDSVVGQDRLVTELDLPRLPYLQAVIKETFRL</u>
<u>HPSTPLSLPRVAAESCEINGYHIPKGATLLVNVWAIARDPDTWAEPLAFRPE</u>
<u>RFLPGGEKPNVDVKGNDFEVIPFGAGRRICAGVSLGLRMVQFMTATLAHAF</u>
<u>DWELANGALPEKLNMDEAYGLTLQRAEPLSVHPKPRLAAHAYKASS</u>

Figure 160: Amino Acid sequence of SeqID 440. The conserved cytochrome P450 family domain is underlined.

MDTDNKLFNVGVLLVATLVVAKLISALLIPRSGKRLPPVVRTWPVVGGLLRFL
KGPMVMLREEYPKLGSVFTLNLLNKKITFFIGPEVSAHFFKASESDLSQQEV
YQFNVPTFGPGVVFDVDYTIRQEQFRFFTEALRINKLKGYVNQMVMEAEDY
FSKWGDSGEVDLKYELEHLTILTASRCLLGREVREKLFDDVSALFHDLDNGM
LPISVIFPYLPIPAHHRRDKARKKLSEIFANIISSRKCAGKSEEDMLQCFIDSKY
KNGRPTTEAEVTGLLIAALFAGQHTSSITSVWTGAYLLTNKKYLSAVSNEQK
HLMEKHGNNVDHDVLSEMDVLYRSIKEALRLHPPLIMLLRSSHSDFSVKTRD
GKEYDIPKGHIVATSPAFANRLPYIYQDPDQYDPDRFAVGREEDKVAGAFSY
ISFGGGRHGCLGEPFAYLQIKAIWTHLLRNFELELVSPFPEIDWNAMVVGVK
GKVMVRYKRRQLSV

Figure 161: Amino Acid sequence of SeqID 441. The conserved cytochrome P450 family domain is underlined.

MDTDNKLFNVGVLLVATLVVAKLISALLIPRSGKRL<u>PPVVRTWPVVGGLLRFL
KGPMVMLREEYPKLGSVFTLNLLNKKITFFIGPEVSAHFFKASESDLSQQEV
YQFNVPTFGPGVVFDVDYTIRQEQFRFFTEALRINKLKGYVNQMVMEAEDY
FSKWGDSGEVDLKYELEHLTILTASRCLLGREVREKLFDDVSALFHDLDNGM
LPISVIFPYLPIPAHHRRDKARKKLSEIFANIISSRKCAGKSEEDMLQCFIDSKY
KNGRPTTEAEVTGLLIAALFAGQHTSSITSVWTGAYLLTNKKYLSAVSNEQK
HLMEKHGNNVDHDVLSEMDVLYRSIKEALRLHPPLIMLLRSSHSDFSVKTRD
GKEYDIPKGHIVATSPAFANRLPYIYQDPDQYDPDRFAVGREEDKVAGAFSY
ISFGGGRHGCLGEPFAYLQIKAIWTHLLRNFELELVSPFPEIDWNAMVVGVK
GKVMVRYKRRQLSV</u>

Figure 162: Amino Acid sequence of SeqID 442. The conserved cytochrome P450 family domain is underlined.

MDLLLLEKTLLGLFAAAIVAIAVSKLRGKRFRLPPGPLPVPIFGNWLQVGDDL
NHRNLTDLAKRFGDILLLRMGQRNLVVVSSPDLSKEVLHTQGVEFGSRTRN
VVFDIFTGKGQDMVFTVYGEHWRKMRRIMTVPFFTNKVVQQYREGWEAEA
AAVVEDVKKNPAAAREGIVLRRRLQMMMYNNMYRIMFDRRFDSEDDPLFVK
LKALNGERSRLAQSFDYNYGDFIPILRPFLRGYLKICKEVKERRLQLFKDYFV
DERKKLASVKRMDNEGLKCAMDHILEAQQKGEINEDNVLYIVENINVAAIETT
LWSIEWGIAELVNHPQIQRKLREEIDAVLGPGVPVTEPELYKLPYLQAVIKETL
RLRMAIPLLVPHMNLHDAKLGGYDIPAESKILVNAWWLANNPAHWKKPEEF
RPERFLEEEAKVEANGNDFRYLPFGVGRRSCPGIILALPILGVTIGQLVQNFE
LLPPPGQSKLDTTEKGGQFSLHILKHSTIVLKPRSF

Figure 163: Amino Acid sequence of SeqID 443. The conserved cytochrome P450 family domain is underlined.

MDLLLLEKTLLGLFAAAIVAIAVSKLRGKRFRLPPGPLPVPIFGNWLQVGDDL
NHRNLTDLAKRFGDILLLRMGQRNLVVVSSPDLSKEVLHTQGVEFGSRTRN
VVFDIFTGKGQDMVFTVYGEHWRKMRRIMTVPFFTNKVVQQYREGWEAEA
AAVVEDVKKNPAAAREGIVLRRRLQMMMYNNMYRIMFDRRFDSEDDPLFVK
LKALNGERSRLAQSFDYNYGDFIPILRPFLRGYLKICKEVKERRLQLFKDYFV
DERKKLASVKRMDNEGLKCAMDHILEAQQKGEINEDNVLYIVENINVAAIETT
LWSIEWGIAELVNHPQIQRKLREEIDAVLGPGVPVTEPELYKLPYLQAVIKETL
RLRMAIPLLVPHMNLHDAKLGGYDIPAESKILVNAWWLANNPAHWKKPEEF
RPERFLEEEAKVEANGNDFRYLPFGVGRRSCPGIILALPILGVTIGQLVQNFE
LLPPPGQSKLDTTEKGGQFSLHILKHSTIVLKPRSF

Figure 164: Amino Acid sequence of SeqID 444. The conserved cytochrome P450 family domain is underlined.

MARLTSFVYATLLASTLIILANFLTSRLSIQLPFWSASLVVSLPLITCLFYLFFD
RGANLPPGPLAIPIFGNWLQVGNDLNHRLLASMSKTYGPVFLLKLGVKKLVV
VSDPELTTHVLHTQGVEFGSRPRNVVFDIFTGNGQDMVFTIYGDHWRKMR
RIMTLPFFTNKVVNTYSDMWEQEMDLVVSDLTKDERVRSEGIVIRKRLQLML
YNIMYRMMFDSKFESMQDPLFIEATKFNSERSRLAQSFDYNYGDFIPMLRPL
LKGYLNKCRDLQRRRLAFFNNYYVERRRKIMAANGDKHQISCAIDYIIDAQM
KGEISEANVLYIVENINVAAIETTLWSMEWAIAELVNHPNVQRKIREEISAVLK
GEPVTESNLHELPYLQATVKETLRLHTPIPLLVPHMNLEEAKLGGYTIPKESK
VVVNAWWLANNPEWWKDAEDFRPERFLEEESGTDAVAGGKVDFRYLPFG
VGRRSCPGIILALPILGLVVAKLVSNFEMKVPPGMDKLDTSEKGGQFSLHIAN
HSTVVFEPVAPREI

Figure 165: Amino Acid sequence of SeqID 445. The conserved O-methyltransferase domain of family 2 is underlined.

MDPSETQSITTPAEDEELVAAFETCILTAVPMVFTSAVELGIIDLLAQEGGASA
RLSPSQIAVRLGITNPDAPRTINRMLRLLASFSYLSCTLHG<u>DQSLYGLGPKSK
YFVNSEAGSFTPLLRFLQHKTVINGWYGLQEAVKNGGSPFQNANGMSIFEC
AMKDPAFSTLLNNGMKAPTPLYMNKLLESYHGFEGAKTVADVGGGVGETL
RLILDKFPNLRGINYDLPHVVKDAPTHPRMEHVGGDLSKSIPKADILFMKVIFI
FFPPFKFTQPILA</u>

Figure 166: Amino Acid sequence of SeqID 446. The conserved O-methyltransferase domain of family 2 is underlined.

MDPSETQSITTPAEDEELVAAFETCILTAVPMVFTSAVELGIIDLLAQEGGASA
RLSPSQIAVRLGITNPDAPRTINRMLRLLASFSYLSCTLHG<u>DQSLYGLGPKSK
YFVNSEAGSFTPLLRFLQHKTVINGWYGLQEAVKNGGSPFQNANGMSIFEC
AMKDPAFSTLLNNGMKAPTPLYMNKLLESYHGFEGAKTVADVGGGVGETL
RLILDKFPNLRGINYDLPHVVKDAPTHPRMEHVGGDLSKSIPKADILFMKVIFI
FFPPFKFTQPILA</u>

Figure_167: Amino Acid sequence of SeqID 447. The conserved O-methyltransferase domain of family 2 is underlined.

MSSKEAPVITTSHEDEEILNAFEVPSMAFVPMVLKGVHELGILELLAKGDQLS
PLDIVARLSIDNPAAPDTIDRMLRLLASYSILSCTLVEDK<u>EGRPQRLYGLGPR
SKFFLDQNGASTLPTHMLLQEKTLLECWNCLKDAVKEGGADPFTRRHGMN
VFDYMGQDPRFNDLYNKSMRTGSAIYMPKIAQHYRGFSKAKTVVNVGGGIG
ETLKTILSKNPHIRAINYDLPHVIATAPPIPGITHVGGDILKSVPKADVHFLKSVL
HRGDDEFCVKVLKNCWEALPPTGKVVIVDEVAPEYPETDIVSQTTLLMDLNA
LRMTGGGKTRTQREFADLAR</u>ASGFHAPKYVLRVYNLWLFELHKM

Figure 168: Amino Acid sequence of SeqID 448. The conserved O-methyltransferase domain of family 2 is underlined MKAKRKDSRKKKFKKKNMSSKEAPVITTSHEDEEILNAFEVPSMAFVPMVLK
GVHELGILELLAKGDQLSPLDIVARLSIDNPAAPDTIDRMLRLLASYSILSCTLV
EDK<u>EGRPQRLYGLGPRSKFFLDQNGASTLPTHMLLQEKTLLECWNCLKDAV
KEGGADPFTRRHGMNVFDYMGQDPRFNDLYNKSMRTGSAIYMPKIAQHYR
GFSKAKTVVNVGGGIGETLKTHTSKNPHIRAINYDLPHVIATAPPIPGITHVGG
DILKSVPKADVHFLKSVLHRGDDEFCVKVLKNCWEALPPTGKVVIVEEVTPE
YPGTDDVSQTTLLMDLNLLRTTPSGKARTQREFADLARA</u>SGFHAPKYVLRV
YNLWLIELHKKM Figure 169: Amino Acid sequence of SeqID 449. The conserved O-methyltransferase domain of family 2 is underlined MKAKRKDSRKKKFKKKNMSSKEAPVITTSHEDEEILNAFEVPSMAFVPMVLK
GVHELGILELLAKGDQLSPLDIVARLSIDNPAAPDTIDRMLRLLASYSILSCTLV
EDK<ins>EGRPQRLYGLGPRSKFFLDQNGASTLPTHMLLQEKTLLECWNCLKDAV</ins>
<ins>KEGGADPFTRRHGMNVFDYMGQDPRFNDLYNKSMRTGSAIYMPKIAQHYR</ins>
<ins>GFSKAKTVVNVGGGIGETLKTHTSKNPHIRAINYDLPHVIATAPPIPGITHVGG</ins>
<ins>DILKSVPKADVHFLKSVLHRGDDEFCVKVLKNCWEALPPTGKVVIVEEVTPE</ins>
<ins>YPGTDDVSQTTLLMDLNLLRTTPSGKARTQREFADLARA</ins>SGFHAPKYVLRV
YNLWLIELHKKM Figure 170: Amino Acid sequence of SeqID 450. The conserved O-methyltransferase domain of family 2 is underlined MKAKRKDSRKKKFKKKNMSSKEAPVITTSHEDEEILNAFEVPSMAFVPMVLK
GVHELGILELLAKGDQLSPLDIVARLSIDNPAAPDTIDRMLRLLASYSILSCTLV
EDKEGRPQRLYGLGPRSKFFLDQNGASTLPTHMLLQEKTLLECWNCLKDAV
KEGGADPFTRRHGMNVFDYMGQDPRFNDLYNKSMRTGSAIYMPKIAQHYR
GFSKAKTVVNVGGGIGETLKTHTSKNPHIRAINYDLPHVIATAPPIPGITHVGG
DILKSVPKADVHFLKSVLHRGDDEFCVKVLKNCWEALPPTGKVVIVEEVTPE
YPGTDDVSQTTLLMDLNLLRTTPSGKARTQREFADLARASGFHAPKYVLRV
YNLWLIELHKKM Figure 171: Amino Acid sequence of SeqID 451. The conserved O-methyltransferase domain of family 2 is underlined MGSTGSETQMTPTQVSDEEANLFAMQLASASVLPMVLKAAIELDLLEIMAKA
GPGAFLSPGEVAAQLPTQNPEAPVMLDRIFRLLASYSVLTCTLRDLP<u>DGKVE
RLYGLAPVCKFLVKNEDGVSIAALNLMNQDKILMESWYYLKDAVLEGGIPFN
KAYGMTAFEYHGTDPRFNKIFNRGMSDHSTITMKKILETYKGFEGLETVVDV
GGGTGAVLSMIVAKYPSMKGINFDLPHVIEDAPPLPGVKHVGGDMFVSVPK
GDAIFMKWICHDWSDDHCAKFLKNCYDALPNNGKVIVAECVLPVYPDTSLAT
KNVIHIDCIMLAHNPGGKERTQKEFEALAK</u>GAGFQGFQVMCCAFGTHVMEF
LKTA Figure 172: Amino Acid sequence of SeqID 452. The conserved O-methyltransferase domain of family 2 is underlined MGSTGSETQMTPTQVSDEEANLFAMQLASASVLPMVLKAAIELDLLEIMAKA
GPGAFLSPGEVAAQLPTQNPEAPVMLDRIFRLLASYSVLTCTLRDLP<u>DGKVE
RLYGLAPVCKFLVKNEDGVSIAALNLMNQDKILMESWYYLKDAVLEGGIPFN
KAYGMTAFEYHGTDPRFNKIFNRGMSDHSTITMKKILETYKGFEGLETVVDV
GGGTGAVLSMIVAKYPSMKGINFDLPHVIEDAPPLPGVKHVGGDMFVSVPK
GDAIFMKWICHDWSDDHCAKFLKNCYDALPNNGKVIVAECVLPVYPDTSLAT
KNVIHIDCIMLAHNPGGKERTQKEFEALAK</u>GAGFQGFQVMCCAFGTHVMEF
LKTA Figure 173: Amino Acid sequence of SeqID 453. The conserved O-methyltransferase domain of family 2 is underlined.

MSACTNQAITTASEDEEFLFAMEMNALIALPLVLKATIELGILEILAECGPMAP
LSPAQIASRLSAKNPEAPVTLDRILRFLASYSILSCTLAQDT<u>EGNPLRLYGLGP
KSKHFVRAHGTATFAAPLMLMLTDNIVTSSWYCLKEEIMEGGDNFKLANGLH
VFEYTNKDRKFNEIFNNAMQAPTNMYMSKIVESYQGFNNVKTVVDVGGGM
GASLRILLSKYPHIHGINFDLPHVIKEAPPYPGIEHVGGDMTNYIPKADVIIMK
WIIHGADDKLCVKLLKNCWEALPEKGKVVIVDAVLPEHPETDIITRNAFLADM
SVLNITPSGKDRTEREFEVLAR</u>ASGFDAPKLVCRAYNMWVVELHKRM

Figure 174: Amino Acid sequence of SeqID 454. The conserved O-methyltransferase domain of family 2 is underlined.

MSSAETLAVTTAQEDEEYLSAIKQNMISCVPLILKATIELGILKLLSESSAQLSP
TQIASRLSIKNPDAGVAIDRILRLLASFSFLSCTLTQDKAGRPERIYSLGPLSK
YYVNEEGASMAPWLLMLFDEVSLRSWFYLKDAVIEGEGDPFKLANGTTLFD
YTGTDPRYNSYFNNAMKCMSTIFMGKFMDTYPGFENAKTVVDVGGGVGEC
LKLILSKHHHLRGINFDLPHVVKNGLSHPGLEHVGGSFVDDPIPKGDILLAKW
QFHSFADDFVIQLLKRCWKALPASGKVVVIDPVSPEYPGTDLVTRATFTSDM
VMLALPPGGKDRTMREVEVVAHATGFSSPKVGCQVLNMWALELYKIA

Figure 175: Amino Acid sequence of SeqID 455. The conserved O-methyltransferase domain of family 2 is underlined.

MSSAETLAVTTAQEDEEYLSAIKQNMISCVPLILKATIELGILKLLSESSAQLSP
TQIASRLSIKNPDAGVAIDRILRLLASFSFLSCTLTQDK<u>AGRPERIYSLGPLSK
YYVNEEGASMAPWLLMLFDEVSLRSWFYLKDAVIEGEGDPFKLANGTTLFD
YTGTDPRYNSYFNNAMKCMSTIFMGKFMDTYPGFENAKTVVDVGGGVGEC
LKLILSKHHHLRGINFDLPHVVKNGLSHPGLEHVGGSFVDDPIPKGDILLAKW
QFHSFADDFVIQLLKRCWKALPASGKVVVIDPVSPEYPGTDLVTRATFTSDM
VMLALPPGGKDRTMREVEVVAH</u>ATGFSSPKVGCQVLNMWALELYKIA

Figure 176: Amino Acid sequence of SeqID 456. The conserved O-methyltransferase domain of family 2 is underlined.

MGSARSETQMTPTQVSDEGANLFAMQLVTASVLPRVLKTTIELDLLEIMARA
GPGACLTPAEVASQLPTQNPDAPVMLDRIFQLLASYSVLTCTLRDLPEGKVE
RLYGLAPVCKFLMKNEDGISIAPLNLMNHSKLAVESWNCLKDAILDGGIPFNK
AHGMTAFDYLGTDPRLNKTFNRLMSDLSTITMKKILETYNGFEGLKTVVDVG
GGTGVVLNMIITKYPSIKGINFDLPHVIENAPSYHGVDHVGGDMFVSVPKGN
AIIIKWICHNWSDEDCAKLLKNCYDALPVNGRVIVAEHILPVYPDPSLATKGVS
HMDCLMLAYCPGGKERTEKEFEALAKGTGFQGFRVTCRAFNSYIMEFLKTA

Figure 177: Amino Acid sequence of SeqID 457. The conserved O-methyltransferase domain of family 2 is underlined.

MDSAGSETQMTPTQVSDEEETLFAMQLATASVLPRVLKATIELDLLEIMARA
GPGAYLTPGEVASQLPTQNPDAPVMLDRIFRLLASYSVLTCTVRDLPEGKVE
RLYGLAPVCKFLVKNEDGVSLAPLNLVNQDKLAVESWYYLKDAILEGGIPFN
KAHGMTAFDYLGTDPRFNKIFNRAMFDFSTITMEKILEKYNGFEGLKTMVDV
GGGTGAVLNMIIAKYPSIKGINFDLPHVIKDAPSYPGVEHVGGDMFVSVPKG
DAIFMKSICHNWNNEHCTKLLKSCYDALPINGRVIVAEYILPVYPDPSLATKG
VIHMDCMMLAHCPGGKERTEKEFEALAKGAGFQGFRVMCRAFNTCVMEFL
KTA

Figure 178: Amino Acid sequence of SeqID 458. The conserved O-methyltransferase domain of family 2 is underlined.

MFFIPPRAAPPKTEASCERERERERERERERERMESLDDTEATLRGQAHIWKH
MFAFVDSMALKCAVELRIPDIIHSYGGGPVTLVQIASRIPSPSPGTTYLARIMR
LLVRKNIFSAHRRQPDGSQESHEMLYSLNPSSRWLLQGPGSENSLAPMVL
MEDHQWLMSPWHCLGDCVRTGGVAFEIAHGRKIWDFASENPEFNHLFNDG
MACTSKILVKAIVEGYKHGFESIGSLVDVGGGTGGAVAEIIKSYPHIQGINFDL
PHVVATAPAHAGVTHVGGDMFETIPHADAVFMKWIMHDWGNEDCVKILKN
CREAIPERNGKVIIAEVVLKPEGDGMFDEIGLVFDLLMIAHSSGGKERDELEW
KKILEEGGFPRYNIIKTPSMLSIIEAYPL

Figure 179: Amino Acid sequence of SeqID 459. The conserved O-methyltransferase domain of family 2 is underlined.

MFFIPPRAAPPKTEASCERERERERERERERERMESLDDTEATLRGQAHIWKH
MFAFVDSMALKCAVELRIPDIIHSYGGGPVTLVQIASRIPSPSPGTTYLARIMR
LLVRKNIFSAHRRQP<u>DGSQESHEMLYSLNPSSRWLLQGPGSENSLAPMVL
MEDHQWLMSPWHCLGDCVRTGGVAFEIAHGRKIWDFASENPEFNHLFNDG
MACTSKILVKAIVEGYKHGFESIGSLVDVGGGTGGAVAEIIKSYPHIQGINFDL
PHVVATAPAHAGVTHVGGDMFETIPHADAVFMKWIMHDWGNEDCVKILKN
CREAIPERNGKVIIAEVVLKPEGDGMFDEIGLVFDLLMIAHSSGGKERDELEW
KKILEEGGFPRYNIIKTPSMLSIIEAYPL</u>

Figure 180: Amino Acid sequence of SeqID 460. The conserved O-methyltransferase domain of family 2 is underlined MDMVNGEMGSQQLLAQAHIWNHIFNFINSMCLKCAIQLGIPDTIHHHGQPMT
LDALVSALQIHPSRAHCVDRLMRILVHSGFFEQKKLA<u>PDGQGAYVLNRVSKL
LLTDNPSNVAPFALSMLDPILINPWHGLSAWFHNHVEPTPFEMVRGMSFWR
YAGQEPGFNRLFNDGMASDARLVASMVVNEHKGVFEGITSLVDVGGGTGT
MAKAIANSFPHMECTIFDLPHVVANLEVSENVRCVPGDMFEAIPPADAIILKWI
LHDWSDEDAVKVLKRCREALGKGEGKKKKVIIIEMVMDNTKSDKEMVETQL
FYDMLMMTLASGRERNEAEWAKLFV</u>AAGFGDYKITPVLGLRSLIEVYPS Figure 181: Amino Acid sequence of SeqID 461. The conserved O-methyltransferase domain of family 2 is underlined MDMVNGEMGSQQLLAQAHIWNHIFNFINSMCLKCAIQLGIPDTIHHHGQPMT
LDALVSALQIHPSRAHCVDRLMRILVHSGFFEQKKLA<u>PDGQGAYVLNRVSKL
LLTDNPSNVAPFALSMLDPILINPWHGLSAWFHNHVEPTPFEMVRGMSFWR
YAGQEPGFNRLFNDGMASDARLVASMVVNEHKGVFEGITSLVDVGGGTGT
MAKAIANSFPHMECTIFDLPHVVANLEVSENVRCVPGDMFEAIPPADAIILKWI
LHDWSDEDAVKVLKRCREALGKGEGKKKKVIIIEMVMDNTKSDKEMVETQL
FYDMLMMTLASGRERNEAEWAKLFV</u>AAGFGDYKITPVLGLRSLIEVYPS Figure 182: Amino Acid sequence of SeqID 462. The conserved O-methyltransferase domain of family 2 is underlined.

MLTFDYKCPSPSAIPPRSVNHFLRRFLSTSRKRPSAHPNRCPTQKHRKRKM
GSAQNQVQPCHEEEDPCLKALLYSSYHVFPVILHAAVELDLFGIIARAGPGA
YVSPAEVVAHLPTQTLESPEIIDRVLRCLASHSLLTYKSETFDE<u>GRTVERRYA
ISPVGKYYVKDEDGGSIGSLSLFAFHRATIDVWLQVKEAMVGGGNLFQKVH
GKTIFQYMKEDSTLNMYFNNAMADLSATQTKKILEVYHGFDGISTLVDVGGG
KGATLNMIVSKYPSIKGINFDLPQVIEHAPPYPGVQHVGGDMFASVPEGDAI
MIKGTCHNWSDESCIKFLKNCYKALPANGKVIVMDFIMPDEPEETMASKYVS
MLDNAMLIQPGGKERTEKQFEYLCKE</u>AGFTGFKVAARAVSALGVIEFTK

Figure 183: Amino Acid sequence of SeqID 463. The conserved O-methyltransferase domain of family 2 is underlined MANNQEREGRDQEDEVGKLAVRLAGAVVLPMTLKSALELGIIDALVSTGGFL
SPTEIASRVGAKNPGAPVLVDRMMRLLASHGVIEWRLRRGDGN<u>GDGGERE
YGPGPMCRFFAKDQEGGDVGPLFLLIHDKVFMESWYHLNDVIMEGGVPFE
RAYGMTAFEYPAIDDRFNQVFNRAMASHTSLIMKKILDVYRGFEGIEVLVDV
GGGVGFNLKMITSKNPHIKGINFDLPHVLADVPSYPGVEHVGGDMFESVPR
GDAIFMKWILHDWSDEHCSKLLKNCFEALPANGKVILVEAILPAVPERNVSSI
NVFQQDLLMLAQNPGGKERTQKEYEVLAV</u>QAGFTGCEVKCCAYNNWVVEF
PKTAGH Figure 184: Amino Acid sequence of SeqID 464. The conserved O-methyltransferase domain of family 2 is underlined MANNQEREGRDQEDEVGKLAVRLAGAVVLPMTLKSALELGIIDALVSTGGFL
SPTEIASRVGAKNPGAPVLVDRMMRLLASHGVIEWRLRRGDGN<u>GDGGERE
YGPGPMCRFFAKDQEGGDVGPLFLLIHDKVFMESWYHLNDVIMEGGVPFE
RAYGMTAFEYPAIDDRFNQVFNRAMASHTSLIMKKILDVYRGFEGIEVLVDV
GGGVGFNLKMITSKNPHIKGINFDLPHVLADVPSYPGVEHVGGDMFESVPR
GDAIFMKWILHDWSDEHCSKLLKNCFEALPANGKVILVEAILPAVPERNVSSI
NVFQQDLLMLAQNPGGKERTQKEYEVLAVQAGFTGCEVKCCAYNNWVVEF
PKTAGH</u>

Figure 185: Amino Acid sequence of SeqID 465. The conserved O-methyltransferase domain of family 2 is underlined.

MDAANSGEMSESEIFRAYAHVWTHTFNFISSMSLKCAIELGIPDTLHRCGHP
MTLPDLATALSVPASKAAFLGRLVAVLVHTGFLSCQKPAPRNNPISEDTA<u>DE
LGFEYSLTPASRVIVKGQPWDMSPIAMVMLNSLLVEPFHCLSEWLKSDSEV
GPSSLRTPFDMKHGKGLWEYASQDEKLNRCLNEGMASDGPMMARLIMDK
CGRRPFEGLRTAVDVAGGIGGLARELAKAFPEMEWTVLDLVHVVAGMEGT
RNLKYVGGDMFEAIPPADAILLKWILHDWSDEESVKILKRCKEAITSNGKMGK
VMIVEIVIGDELEEFHTTKLFYDMMLMGCLTGKERNEKEWAKLFR</u>EAGFSDY
KLTPLAGFRSLIEVYP

Figure 186: Amino Acid sequence of SeqID 466. The conserved O-methyltransferase, family 2 domain is underlined MQKHRERKMSSAQNQVKPCHEEEEEEDPCLKALLYSSSQVFPRILHAAVEL
DLFGIIARAGPGAYMSPPEVAAHLPAQTPESAEIIDRVLRCLASHSLLSCKSE
TLDS<u>GRTVERRYAISPAGKYYVRDEDGSSVGSQALFAFHRATIDVWLQFKE
AILGGGGNLFQKVHGKTIFQCMKEDSSLNKHFNDAMVGVSKMQTRKILEVY
HGFDGIRTLVDVGGGKGATLNMIVSKYPSIKGINFDLAQVIEHAPSYPGVEHI
GGDMFVSVPEGDAIMIKSTCQNWSDESCIKLLKNCYKALPANGKVIVMDFIM
PDEPEDTMASRYVSLLDNAMLIMPGGKERTEKQFEYLCRE</u>AGFTGFKVAAR
AVSALGVIEFTK Figure 187: Amino Acid sequence of SeqID 467. The conserved O-methyltransferase, family 2 domain is underlined MQKHRERKMSSAQNQVKPCHEEEEEEDPCLKALLYSSSQVFPRILHAAVEL
DLFGIIARAGPGAYMSPPEVAAHLPAQTPESAEIIDRVLRCLASHSLLSCKSE
TLDSGRTVERRYAISPAGKYYVRDEDGSSVGSQALFAFHRATIDVWLQFKE
AILGGGGNLFQKVHGKTIFQCMKEDSSLNKHFNDAMVGVSKMQTRKILEVY
HGFDGIRTLVDVGGGKGATLNMIVSKYPSIKGINFDLAQVIEHAPSYPGVEHI
GGDMFVSVPEGDAIMIKSTCQNWSDESCIKLLKNCYKALPANGKVIVMDFIM
PDEPEDTMASRYVSLLDNAMLIMPGGKERTEKQFEYLCREAGFTGFKVAAR
AVSALGVIEFTK Figure 188: Amino Acid sequence of SeqID 468. The conserved O-methyltransferase domain of family 2 is underlined.

MDTSETQSITTPAEDEELVAAFETCILTAVPMVLRSAVELGIIDLLAREGGASA
QLSPSQIAAHLGIANPDAPRTINRMLRLLASFSYLSCTLHG<u>DQSLYGLGPKSK
YFVSSEAGSFAPLLRFLQHKTLINSWYGLQEAVKNGGGLFENANGTNIFEYA
GKDPALNTVFNNGMESPTPLYMNKILESYRGFEGAKTIADLGGGVGQNLRLI
LDKFPNLRGILYDLPHVIKDAPAHPRMERVGGDLLKSVPKADILFMKWLFHG
LRDDFCKMLLQNCYEALPPNGKVVIVDPILPEYPETDIVSRNSFTSDMIMLYT
SPGEDRTRKELEVLAL</u>

Figure_189: Amino Acid sequence of SeqID 469. The conserved O-methyltransferase domain of family 2 is underlined.

MSSAQNQVKPCHEEEEEEDPCLKALLYSSSQAFPRILHAAVELDLFGIIARA
GPGAYMSPPEVAAHLPAQTPESAEIIDRVLRCLASHSLLSCKSETLDS<u>GRTV
ERRYAISPAGKYYVRDEDGTSVGSQALFAFHRATIDVWLQFKEAILGGGGNL
FQKVHGKTIFQCMKEDSSLNKHFNDAMVGVSKMQTRKILEVYHGFDGIRTL
VDVGGGKGATLNMIVSKYPSIKGINFDLAQVIEHAPSYPGVEHIGGDMFVSV
PEGDAIMIKSTCHNWSDESCIKLLKNCYKAVPANGKVIVMDFIMPDEPEETM
ASRYVSLLDNAMLIQPGGKERTEKQFEHLCR</u>EAGFTGFKVAARAVSALGVIE
FTK

Figure 190: Amino Acid sequence of SeqID 470. The conserved O-methyltransferase domain of family 2 is underlined.

MGSTGSETQMTPTQVSDEEANLFAMQLASASVLPMVLKAAIELDLLEIMAKA
GPGAFLSPGEVAAQLPTQNPEAPVMLDRIFRLLASYSVLTCTLRDLP<u>DGKVE
RLYGLAPVCKFLVKNEDGVSIAALNLMNQDKILMESWYYLKDAVLEGGIPFN
KAYGMTAFEYHGTDPRFNKIFNRGMSDHSTITMKKILETYKGFEGLETVVDV
GGGTGAVLSMIVAKYPSMKGINFDLPHVIEDAPPLPGVKHVGGDMFVSVPK
GDAIFMKWICHDWSDDHCAKFLKNCYDALPNNGKVIVAECVLPVYPDTSLAT
KNVIHIDCIMLAHNPGGKERTQKEFEALAK</u>GAGFQGFQVMCCAFGTHVMEF
LKTA

Figure 191: Amino Acid sequence of SeqID 471. The conserved O-methyltransferase domain of family 2 is underlined.

MADNQEREGRDQEEEVWKLAAQLLGAVMLPMTLKSALELGIIDALISAGGFL
SPAEIARRVGAKNPRAPVLVDRMMSLLASHSVIEWRLRRGDGD<u>GDGGERE
YGPGPVCRFFAKDEEGGAIGPLFLLTYDKVFMESWYHLNDVIMEGGVPFER
AYGMTAFEYPAIDDRFNQVFNRAMVSHTSLIMKKILDVYRGFEGIEVLVDVG
GGVGFNLNMITSKHPHIKGINFDLPHVLADAPSYPGVEHVGGDMFESVPRG
DAIFMKWILHDWSDEHCLKLLKNCFEALPANGKVILVEAILPVVPERNVSSNI
VFQQDLFMLAQNPGGKERTQKEYEALAL</u>QAGFSGCEVKCCAYDSWVVEFP
KTAGH

Figure 192: Amino Acid sequence of SeqID 472. The conserved O-methyltransferase domain of family 2 is underlined.

MEQGWDKGEILASKALSKYI<u>LETNAYPREHEQLKELREATVQKYQIRSIMNV
PVDEGQLISMMLKLMNAKKTIEIGVFTGYSLLTTALALPADGKIIAIDRDKEAY
EIGLPYIKKAGVDHKINFIQSDAFSVLNDLIVNSQEQGTFDFAFVDAKKDDYM
KYHELMLKLVKVGGMIGYDDTLWFGAVALSETDDMGDHLKLWRDQLREFN
SFLGKDPRVECCLLSVGGGLTLCRRLY</u>

Figure 193: Amino Acid sequence of SeqID 473. The conserved O-methyltransferase domain of family 2 is underlined.

MEQGWDKGEILASKALSKYILETNAYPREHEQLKELREATVQKYQIRSIMNV
PVDEGQLISMMLKLMNAKKTIEIGVFTGYSLLTTALALPADGKIIAIDRDKEAY
EIGLPYIKKAGVDHKINFIQSDAFSVLNDLIVNSQEQGTFDFAFVDAKKDDYM
KYHELMLKLVKVGGMIGYDDTLWFGAVALSETDDMGDHLKLWRDQLREFN
SFLGKDPRVECCLLSVGGGLTLCRRLY

Figure 194: Amino Acid sequence of SeqID 474. The conserved O-methyltransferase domain of family 2 is underlined.

MATAGEESQTQAGRHQEVGHKSLLQSDALYQYI<u>LETSVYPREPEPMKELRD
ITAKHPWNIMTTSADEGQFLNMLLKLINAKNTMEIGVFTGYSLLATALALPDD
GKILAMDINRENYELGLPVIQKAGVADKIDFREGPALPILDQLIEDGKQGSFDF
IFVDADKDNYLNYHKRLIELVKVGGLIGYDNTLWNGSVVAPPDAPLRKYVRY
YRDFVLELNKALAADPRIEICMLPVGDGITLCRRIS</u>

Figure 195: Amino Acid sequence of SeqID 475. The conserved O-methyltransferase domain of family 2 is underlined.

MAANAEPQQTQPAKHSEVGHKSLLQSDALYQYILETSVYPREPEPMKELREI
TAKHPWNLMTTSADEGQFLNMLLKLINAKNTMEIGVYTGYSLLATALALPDD
GKILAMDINRENFEIGLPVIQKAGLAHKIDFREGPALPLLDQLVQDEKNHGTY
DFIFVDADKDNYINYHKRLIDLVKVGGLIGYDNTLWNGSVVAPADAPLRKYVR
YYRDFVLELNKALAVDPRIEICMLPVGDGITLCRRVS

Figure 196: Amino Acid sequence of SeqID 476. The conserved O-methyltransferase domain of family 2 is underlined.

MAANAEPQQTQPAKHSEVGHKSLLQSDALYQYI<u>LETSVYPREPEPMKELREI
TAKHPWNLMTTSADEGQFLNMLLKLINAKNTMEIGVYTGYSLLATALALPDD
GKILAMDINRENFEIGLPVIQKAGLAHKIDFREGPALPLLDQLVQDEKNHGTY
DFIFVDADKDNYINYHKRLIDLVKVGGLIGYDNTLWNGSVVAPADAPLRKYVR
YYRDFVLELNKALAVDPRIEICMLPVGDGITLCRRVS</u>

Figure 197: Amino Acid sequence of SeqID 477. The conserved O-methyltransferase domain of family 2 is underlined.

MAANAEPQQTQPAKHSEVGHKSLLQSDALYQYI<u>LETSVYPREPEPMKELREI
TAKHPWNLMTTSADEGQFLNMLLKLINAKNTMEIGVYTGYSLLATALALPDD
GKILAMDINRENFEIGLPVIQKAGLAHKIDFREGPALPLLDQLVQDEKNHGTY
DFIFVDADKDNYINYHKRLIDLVKVGGLIGYDNTLWNGSVVAPADAPLRKYVR
YYRDFVLELNKALAVDPRIEICMLPVGDGITLCRRVS</u>

Figure 198: Amino Acid sequence of SeqID 478. The conserved O-methyltransferase domain of family 2 is underlined.

MAANAEPQQTQPAKHSEVGHKSLLQSDALYQYI<u>LETSVYPREPEPMKELREI
TAKHPWNLMTTSADEGQFLNMLLKLINAKNTMEIGVYTGYSLLATALALPDD
GKILAMDINRENFEIGLPVIQKAGLAHKIDFREGPALPLLDQLVQDEKNHGTY
DFIFVDADKDNYINYHKRLIDLVKVGGLIGYDNTLWNGSVVAPADAPLRKYVR
YYRDFVLELNKALAVDPRIEICMLPVGDGITLCRRV</u>S

Figure 199: Amino Acid sequence of SeqID 479. The conserved O-methyltransferase domain of family 3 is underlined.

MEEKTKVFSSSNKGLLQSKELYQYILDTSVYPREPELLRELREVTATHPRAG
MGTAPDSGQLMAILLKLLNAKRTIEIGVFTGYSLLLTALNIPEDGKIIAIDEDRA
AYEMGLPIIKKAGVEHKIDFIESKALQALDKIMQKPDSEGSFDFAFVDADKVN
YWNYHERLLKLVKVGGLAVYDNTLWGGSVAMPEDAVGHMLKEGRKLTIEF
NNLLAKDARVQICHASIGDGMTICKRIS

Figure 200: Amino Acid sequence of SeqID 480. The conserved haem peroxidase family domain is underlined and the peroxidases active site signature is in bold.

MATHDMVGFSVVVVVLLATSVITTARCKLSPSHYQSTCPKALSI<u>VRAGVAKAIK NETRTGASLLRLHFHDCFVNGCDASILLDDTPSFVGEKTAAPNNNSVRGFE VIDRIKASLEKECPGVVSCADIVALAARDSVVHLGGPSWSVSLGRKDSITAS RSLANTSIPPPTSNLSALITSFAAQGLSVKNMVALSGSHTIGLARCTSFRGRIY NDSNIDTSFAHKLQKICPKIGNDSVLQRLDIQTPTFFDNLYYHNLLQKKGLLH SDQELFNGSSVDSLVKKYACD</u>TGKFFRDFAKAMIKMSEIRPPKGSNGQIRKN CRKVN

Figure 201: Amino Acid sequence of SeqID 481. The conserved haem peroxidase family domain is underlined and the peroxidases active site signature is in bold.

MATHDMVGFSVVVVLLATSVITTARCKLSPSHYQSTCPKALSI<u>VRAGVAKAIK
NETRTGASLLRLHFHDCFVNGCDASILLDDTPSFVGEKTAAPNNNSVRGFE
VIDRIKASLEKECPGVVSCADIVALAARDSVVHLGGPSWSVSLGRKDSITAS
RSLANTSIPPPTSNLSALITSFAAQGLSVKNMVALSGSHTIGLARCTSFRGRIY
NDSNIDTSFAHKLQKICPKIGNDSVLQRLDIQTPTFFDNLYYHNLLQKKGLLH
SDQELFNGSSVDSLVKKYACD</u>TGKFFRDFAKAMIKMSEIRPPKGSNGQIRKN
CRKVN

Figure 202: Amino Acid sequence of SeqID 482. The conserved haem peroxidase family domain is in underlined. The peroxidases active site signature and the peroxidases proximal heme-ligand signature are in bold.

MGKSYPTVSEEYKKAVEKCKKKLRGLIAEKSCAPLMLRIAWHSAGTFDVKT
KTGGPFGTMKHAAELSHGANSGLDVAVRLLQPIKDQFPIITYADFYQLAGVV
AVEVTGGPEVAFHPGREDKPQPPPEGRLPDATKGCDHLRQVFGVQMGLSD
KDIVALSGGHTLGRCHKERSGFEGTWTANPLIFDNSYFKELLSGEKKELLQL
PSDKALLADPVFRPLVEKYAADEDAFFEDYAEAHLKLSELGFADA

Figure 203: Amino Acid sequence of SeqID 483. The conserved haem peroxidase family domain is in underlined. The peroxidases active site signature and the peroxidases proximal heme-ligand signature are in bold.

MGKSYPTVSEEYKKAVEKCKKKLRGLIAEKSCAPLMLRIAWHSAGTFDVKT
KTGGPFGTMKHAAELSHGANSGLDVAVRLLQPIKDQFPIITYADFYQLAGVV
AVEVTGGPEVAFHPGREDKPQPPPEGRLPDATKGCDHLRQVFGVQMGLSD
KDIVALSGGHTLGRCHKERSGFEGTWTANPLIFDNSYFKELLSGEKKELQL
PSDKALLADPVFRPLVEKYAADEDAFFEDYAEAHLKLSELGFADA

Figure 204: Amino Acid sequence of SeqID 484. The conserved haem peroxidase family domain is underlined and the peroxidases proximal heme-ligand signature is in bold.

MASRFSSFVLISCLVIASSPVHVSSSAHLVKGLSWSFYEKSCPKVESV<u>IRKHL
KKVFEKDIGQAAGLLRVHFHDCFVKGCDGSVLLDGSANEPSEQDAPPNRSL
RRTAFKIIDDLSQLVEKKCGQVVSCADIAAIAARDSVFLSGGPEYDVPLGRRD
GLTPATENVVIENIPAPTENASEILSALAKKNFDATDVVALSGGHTIGLAHCTA
FENRLYPTQDPTMAKTFAHDLKGVCPTTNSTNTTVLDIRSPNRFDNKYFVDL
MNRQGLFTSDQDLYEDPTTRDIVTSFAED</u>QELFFEKFVLAMTKMGQLSVLT
GTKGEIRANCSVRNSENPDLLKFVVEEDLESYAELK

Figure 205: Amino Acid sequence of SeqID 485. The conserved haem peroxidase family domain is underlined. The peroxidases active site signature and the peroxidases proximal heme-ligand signature are in bold.

MASRFSSFVLVSFLVIAASHVHVTSSAHLVKGLSWSFYEKSCPKVESV<u>IKKH</u>
<u>LKKVFEEDIGQAAGLLRLHFHDCFVKGCDASVLLDGSASGPSEQDAPPNRS</u>
<u>LRPSAFKIIDDLRELVDKKCGRVVSCADIAAIAARDSVVLSGGPEYDVPLGRR</u>
<u>DGLTFATQNVTLENLPAPTENASAILSALAKKNLDATDVVALSGGHTIGLGHC</u>
<u>TSFENRLYPTQDPTMEKTFAHDLKGVCPTTNSTNTTVLDIRSPNRFDNKYFV</u>
<u>DLVNRQGLFTSDQDLYEDPATRDIVTSFAEDQELFFEKFVLAMTKMGQFGLL</u>
<u>TGTKGEIRANCSVRNSENPDLLKSVVEEDLESYAELK</u>

Figure 206: Amino Acid sequence of SeqID 486. The conserved haem peroxidase family domain is underlined. The peroxidases active site signature and the peroxidases proximal heme-ligand signature are in bold.

MASRFSSFVLVSFLVIAASHVHVTSSAHLVKGLSWSFYEKSCPKVESV<u>IKKH
LKKVFEEDIGQAAGLLRLHFHDCFVKGCDASVLLDGSASGPSEQDAPPNRS
LRPSAFKIIDDLRELVDKKCGRVVSCADIAAIAARDSVVLSGGPEYDVPLGRR
DGLTFATQNVTLENLPAPTENASAILSALAKKNLDATDVVALSGGHTIGLGHC
TSFENRLYPTQDPTMEKTFAHDLKGVCPTTNSTNTTVLDIRSPNRFDNKYFV
DLVNRQGLFTSDQDLYEDPATRDIVTSFAEDQELFFEKFVLAMTKMGQFGLL
TGTKGEIRANCSVRNSENPDLLKSVVEEDLESYAELK</u>

Figure 207: Amino Acid sequence of SeqID 487. The conserved haem peroxidase family domain is underlined. The peroxidases active site signature and the peroxidases proximal heme-ligand signature are in bold.

MASRFSSFVLVSFLVIAASHVHVTSSAHLVKGLSWSFYEKSCPKVESV<u>IKKH</u>
<u>LKKVFEEDIGQAAGLLRLHFHDCFVKGCDASVLLDGSASGPSEQDAPPNRS</u>
<u>LRPSAFKIIDDLRELVDKKCGRVVSCADIAAIAARDSVVLSGGPEYDVPLGRR</u>
<u>DGLTFATQNVTLENLPAPTENASAILSALAKKNLDATDVVALSGGHTIGLGHC</u>
<u>TSFENRLYPTQDPTMEKTFAHDLKGVCPTTNSTNTTVLDIRSPNRFDNKYFV</u>
<u>DLVNRQGLFTSDQDLYEDPATRDIVTSFAEDQELFFEKFVLAMTKMGQFGLL</u>
<u>TGTKGEIRANCSVRNSENPDLLKSVVEEDLESYAELK</u>

Figure 208: Amino Acid sequence of SeqID 488. The conserved haem peroxidase family domain is underlined. The peroxidases active site signature and the peroxidases proximal heme-ligand signature are in bold.

MALPVVDTEYLKEIDKARRHLRALIAYKNCAPIMLRLAWHDAGTYDARTKTG
GPTGSIRNEEEYSHGANAGLKIALDFCEDVKSKCPRITYADLYQLAGVVAVE
VTGGPTIDFVPGRKDSRVSPNEGRLPDANQGPPHLRDIFYRMGLSDK**DIVA
LSGAHTL**GRAHPERSGFDGPWTQEPLKFDNSYFVELLKGESEGLLKLPTDK
ALLEDPAFRPYVELYAKDADAFFRDYVISHKKLSELGFTPSSSGSKTVANGA
VLAQGAVGVAVAAAVVILSYFYEVRKKMK

Figure 209: Amino Acid sequence of SeqID 489. The conserved haem peroxidase family domain is underlined MASKALIFLALLSFSAVSPRPAIAEINEEDKPGLVMNFYKDTCPQAEDI<u>IKEQV
KLLYKRHKNTAFSWLRNIFHDCAVQSCDASLLLDSTRRSLSEKETDRSFGLR
NFRYLDTIKEAVERECPGVVSCADILVLSARDGIVALGGPHFPLKTGRRDGR
KSRADVVEQYLPDHNESISVVLDRFAAMGINTPGVVALLGAHSVGRTHCVKL
VHRLYPEVDPALNPDHIEHMLHKCPDAIPDPKAVQYCEDDRGTPMVLDNNY
YRNILDNKGLLIVDHQLATDKRTKPYVKEDAKS</u>QDYFFKEFARAITILSENNPL
TGDQGEIRKQCNVANKHH Figure 210: Amino Acid sequence of SeqID 490. The conserved haem peroxidase family domain is underlined MMVLSHAPSSLMGIAVFAALLFLLHPSSAQLSSNFYATSCPNVSNI<u>VQTVIQQ
ALQSDPRITASLLRLHFHDCFVDGCDGSLLLDNSANISSEKDAAPNTNSTRG
FDVVDNIKSAIESSCPGTVSCADILALGAQASVVLSGGPSWTVLLGRRDSLT
ANQAGANTSIPSPFGSLANLTSQFAAVGLDTNDLVTLSGAHTFGRAQCRTFS
PRLYNFTNGGPDPTISPSYLTTLQQLCPQNGNGSVPANLDPTTVNTFDNNY
YANLQNNQGLLQSDQELFSTSGAATISIVNSF</u>SGNQSAFFQSFAQSMINMG
NISPLTGSSGEIRSNCRKVNGS Figure 211: Amino Acid sequence of SeqID 491. The conserved haem peroxidase family domain is underlined MMVLSHAPSSLMGIAVFAALLFLLHPSSAQLSSNFYATSCPNVSNI<u>VQTVIQQ
ALQSDPRITASLLRLHFHDCFVDGCDGSLLLDNSANISSEKDAAPNTNSTRG
FDVVDNIKSAIESSCPGTVSCADILALGAQASVVLSGGPSWTVLLGRRDSLT
ANQAGANTSIPSPFGSLANLTSQFAAVGLDTNDLVTLSGAHTFGRAQCRTFS
PRLYNFTNGGPDPTISPSYLTTLQQLCPQNGNGSVPANLDPTTVNTFDNNY
YANLQNNQGLLQSDQELFSTSGAATISIVNSFSGN</u>QSAFFQSFAQSMINMG
NISPLTGSSGEIRSNCRKVNGS Figure 212: Amino Acid sequence of SeqID 492. The conserved haem peroxidase family domain is underlined MASPSSFSKAILTLACVVLLMGGTRAQLSTDFYAKTCPKLFPT<u>VKKIVRAAIA
NETRMGASLLRLFFHDCFVNGCDGSNLLDDTPTFTGEKNAMPNQNSLRGF
DVVDRIKSAVEKVCPSIVSCADLLAIIARDSVGILGGPMWDVKLGRRDARTAS
QAAANNSIPPPTNNLSALISSFQNQGLSLKDLVALYGGHTIGQARCTNFRARI
YNESNLDSSFARVAKSNCPRVTGVGDNNLAGLDFQSATSFDNSYYINLIKKR
GLLHSDQQLFNGGSTDSFIRTYAKS</u>QSTFFKDFVASIIKMGDIKPLTGSNGEI
RKKCRRVN Figure 213: Amino Acid sequence of SeqID 493. The conserved haem peroxidase family domain is underlined MAIGVALFSSLLVLSFVSPISSLSSNYYDKTCPNAEL<u>IVANAVKNAAMKDKTV</u>
<u>PAALLRMHFHDCFIRGCDASVLLNSKGSNKAEKDGPPNVSLHSFFVIDNAKK</u>
<u>ELEASCPGVVSCADILALAARDSVVLSGGPTWDVPKGRKDGRTSKASETTQ</u>
<u>LPAPLFNISQLQQSFSQRGLSMEDLVALSGGHTLGFSHCSSFAGRIRNFNTT</u>
<u>HDIDPSMHPSLAASLRGVCPSKNRPKNAGTTMDPSSTTFDNTYYRLILQGK</u>
<u>GLFSSDQALLAVPKTKDLVEKFAG</u>SHKEFTDAFVKSMIKMSSITGGGEVRKD
CRVVN Figure 214: Amino Acid sequence of SeqID 494. The conserved haem peroxidase family domain is underlined

```
MAIGVALFSSLLVLSFVSPISSLSSNYYDKTCPNAELIVANAVKNAAMKDKTV
PAALLRMHFHDCFIRGCDASVLLNSKGSNKAEKDGPPNVSLHSFFVIDNAKK
ELEASCPGVVSCADILALAARDSVVLSGGPTWDVPKGRKDGRTSKASETTQ
LPAPLFNISQLQQSFSQRGLSMEDLVALSGGHTLGFSHCSSFAGRIRNFNTT
HDIDPSMHPSLAASLRGVCPSKNRPKNAGTTMDPSSTTFDNTYYRLILQGK
GLFSSDQALLAVPKTKDLVEKFAGSHKEFTDAFVKSMIKMSSITGGGEVRKD
CRVVN
```

Figure 215: Amino Acid sequence of SeqID 495. The conserved haem peroxidase family domain is underlined and the peroxidases proximal heme-ligand signature is in bold.

MSPPPSPPPRCPALLRIAPLLLAVLLASSAAPAASRLTADYYAKSCPRFHQIV
QDTVTSKQISTPTTAAATLRVLFHDCFGTGCDGSILLSAAPLAPPPERDADIN
LSLPGDAFDLVVRAKTALELACPGTVSCSDILVVAARDLVTMLGGPYYDVFL
GRRDTRISRASLVAGLLPRPNMTMSELLSLFGARGFSAQEMVALAGAHTVG
FSHCKEFSSGIYGFSKSSSYDPTYNPRFAQGLQKACASYGKDPTLSVFNDV
MTPNKFDNMYYQNLPKGLGLLASDRGLYGDPRTRPFVEMYARDQDRFFKD
FARAMQKLSLYGVQTGRRGEIRRRCDAIN

Figure 216: Amino Acid sequence of SeqID 496. The conserved haem peroxidase family domain is underlined. The peroxidases proximal heme-ligand signature and the peroxidases active site signature are in bold.

MAWESSSVRTAFLLLLSFLLGTASAQLSSTFYSTSCPSALST<u>IKSGVSSAVKS
EARMGASLLRLHFHDCFVNGCDASVLLDDTANFTGEKNATPNANSLRGFD
VIDTIKSQLESACPGVVSCADLLTVAARDSVVALGGPSWTVPLGRRDSTTAS
QSAANSNIPAPTLNLSGLITAFSNKGFTTKEMVALSGSHTIGQARCTSFRARL
YNETNINTTFATSLKANCPSSGGDNNLSPLDTTSPTSFDNAYFKNLQIQEGLL
HSDQQLFSGGSTDAQVNAYSSN</u>SATFMTDFANAMVKMGNLSPLTGSSGQI
RKSCGKVN

Figure 217: Amino Acid sequence of SeqID 497. The conserved haem peroxidase family domain is underlined.

MAAQKLLSLLVFQLALVAFILDVANAQGLKVGFYKNTCPQAEEI<u>VKKAAASFI
SRAPSLAAPLLRMHFHDCFVRGCDGSVLLNSTSSNQAEKDAFPNLSLRGYQ
VIDAAKDALEKKCPGVVSCADILALVARDAVSMMNGPFWQVPTGRRDGRVS
NLQDALNNLPGPAFSISALKSSFAAKGLSVKDLAVLSGGHTLGMSHCSSFTN
RLYNFTGKNDADPSMDPNYVAQLKTKCKPNDATTIVEMDPGSAKKFDVDYY
TLVSKRRGLFQSDAALLTDSTTNAYVQLQLTS</u>KSTFAEDFGVSMVNMGNIG
VLTGNSGEIRKKCYLVN

Figure 218: Amino Acid sequence of SeqID 498. The conserved haem peroxidase family domain is underlined.

MPHLTSHSSPLTCSSTLFIALILICSQPNGSTAAAAANATGRHRQMSFDYYAK
SCPQVEQLIGSVTSQQFKEAPVSGPATIRLFFHDCFVEGCDGSILISSKPGSK
ELAEKDAIDNKDLRAEGFETIAKAKSLVENKCPGLVSCADILAIAARDFVHLS
GGPYYQVKKGRWDGRISKAARVPPNIPRANSTVDQLLKLFNSKGLTLADMV
VLSGAHTIGFAHCVQFSSRLYNYKGTKRPDPVIDPRLLKALRMSCPQFGGN
KDIVAPFDVTTPFLFDHTYYANLEAKLGLLASDQALFSDPRTRPVVQDMAKD
KQKFFQAFGAAMEKMGMIGVKRGRKHGERRRDCSSHG

Figure 219: Amino Acid sequence of SeqID 499. The conserved phenylalanine/histidine ammonia-lyase family domain is underlined and the phenylalanine and histidine ammonia-lyases signature is in bold.

MEMESTTGTGNGLHGLCAAGSHHADPLNWGAAAAALTGSHLDEVKRMVE
EYRRPAVRLGGESLTIAQVAAVASQEGVGVELSEAARPRVKASSDWVMES
MNKGTDSYGVTTGFGATSHRRTKQGGALQKELIRFLNAGIFGNGTESCHTL
PQSSTRAAMLVRVNTLLQGYSGIRFEILEAITKFLNHNITPCLPLRGTITASGD
LVPLSYIAGLLTGRPNSKAVGPDGKSLDAVEAFRLAGIDTGFFELQPKEGLA
LVNGTAVGSGLASIVLFEANILAVLSEVLSAIFAEVMQGKPEFTDHLTHKLKH
HPGQIESAAIMEHILDGSAYVKAAKKLHEMDPLQKPKQDRYALRTSPQWLG
PQIEVIRAATKMIEREINSVNDNPLIDVARNKALHGGNFQGTPIGVSMDNTRL
AIASIGKLMFAQFSELVNDFYNNGLPSNLSGGRNPSLDYGFKGAEIAMASYC
SELQFLANPVTNHVQSAEQHNQDVNSLGLISSRKTAEAIDILKLMSSTFLVAL
VPAVDLRHLEENLKSTVKNTVGRVARKVLMVGANGELHPSHYCERDLLKVV
DREHVFTYADDACSATYPLMQKLRQVLVDQALVNGESELNPSTSIFQKIVAF
EEELKAQLPKDVEGVRVQYETGNLAIPNQIKECRSYPLYKLVREELGTALLT
GEGVISPGEDFDKVFTAICAGKLIDPLLECLSGWNGAPLPIS

Figure 220: Amino Acid sequence of SeqID 500. The conserved phenylalanine/histidine ammonia-lyase family domain is underlined and the phenylalanine and histidine ammonia-lyases signature is in bold.

MEMESTTGTGNGLHGLCAAGSHHADPLNWGAAAAALTGSHLDEVKRMVE
EYRRP<u>AVRLGGESLTIAQVAAVASQEGVGVELSEAARPRVKASSDWVMES</u>
<u>MNKGTDSYGVTTGFGATSHRRTKQGGALQKELIRFLNAGIFGNGTESCHTL</u>
<u>PQSSTRAAMLVRVNTLLQGYSGIRFEILEAITKFLNHNITPCLPLRGTITASGD</u>
<u>LVPLSYIAGLLTGRPNSKAVGPDGKSLDAVEAFRLAGIDTGFFELQPKEGLA</u>
<u>LVNGTAVGSGLASIVLFEANILAVLSEVLSAIFAEVMQGKPEFTDHLTHKLKH</u>
<u>HPGQIESAAIMEHILDGSAYVKAAKKLHEMDPLQKPKQDRYALRTSPQWLG</u>
<u>PQIEVIRAATKMIEREINSVNDNPLIDVARNKALHGGNFQGTPIGVSMDNTRL</u>
<u>AIASIGKLMFAQFSELVNDFYNNGLPSNLSGGRNPSLDYGFKGAEIAMASYC</u>
<u>SELQFLANPVTNHVQSAEQHNQDVNSLGLISSRKTAEAIDILKLMSSTFLVAL</u>
<u>VPAVDLRHLEENLKSTVKNTVGRVARKVLMVGANGELHPSHYCERDLLKVV</u>
<u>DREHVFTYADDACSATYPLMQKLRQVLVDQALVNGESELNPSTSIFQKIVAF</u>
EEELKAQLPKDVEGVRVQYETGNLAIPNQIKECRSYPLYKLVREELGTALLT
GEGVISPGEDFDKVFTAICAGKLIDPLLECLSGWNGAPLPIS

Figure 221: Amino Acid sequence of SeqID 501. The conserved
phenylalanine/histidine ammonia-lyase family domain is underlined and the
phenylalanine and histidine ammonia-lyases signature is in bold.

MEMESTTGTGNGLHGLCAAGSHHADPLNWGAAAAALTGSHLDEVKRMVE
EYRRP<u>AVRLGGESLTIAQVAAVASQEGVGVELSEAARPRVKASSDWVMES
MNKGTDSYGVTTGFGATSHRRTKQGGALQKELIRFLNAGIFGNGTESCHTL
PQSSTRAAMLVRVNTLLQGYSGIRFEILEAITKFLNHNITPCLPLR**GTITASGD
LVPLSYIA**GLLTGRPNSKAVGPDGKSLDAVEAFRLAGIDTGFFELQPKEGLA
LVNGTAVGSGLASIVLFEANILAVLSEVLSAIFAEVMQGKPEFTDHLTHKLKH
HPGQIESAAIMEHILDGSAYVKAAKKLHEMDPLQKPKQDRYALRTSPQWLG
PQIEVIRAATKMIEREINSVNDNPLIDVARNKALHGGNFQGTPIGVSMDNTRL
AIASIGKLMFAQFSELVNDFYNNGLPSNLSGGRNPSLDYGFKGAEIAMASYC
SELQFLANPVTNHVQSAEQHNQDVNSLGLISSRKTAEAIDILKLMSSTFLVAL
VPAVDLRHLEENLKSTVKNTVGRVARKVLMVGANGELHPSHYCERDLLKVV
DREHVFTYADDACSATYPLMQKLRQVLVDQALVNGESELNPSTSIFQKIVAF
EEELKAQLPKDVEGVRVQYETGNLAIPNQIKECRSYPLYKLVREELGTALLT
GEGVISPGEDFDKVFTAICAGKLIDPLLECLSGWNGAPLPIS</u>

Figure 222: Amino Acid sequence of SeqID 502. The conserved phenylalanine/histidine ammonia-lyase family domain is underlined and the phenylalanine and histidine ammonia-lyases signature is in bold.

MEMESTTGTGNGLHGLCAAGSGHA<u>DPLNWGAAAAALTGSHLDEVKRMVE</u>
<u>EYRRPAVASQEGVGVELSEAARPRVKASSDWVMESMNKGTDSYGVTTGF</u>
<u>GATSHRRTKQGGALQKELIRFLNAGIFGNGTESCHTLPQSSTRAAMLVRVN</u>
<u>TLLQGYSGIRFEILEAITKFLNHNITPCLPLRGTITASGDLVPLSYIAGLLTGRP</u>
<u>NSKAVGPDGKSLDAVEAFRLAGIDTGFFELQPKEGLALVNGTAVGSGLASIV</u>
<u>LFEANILAVLSEVLSAIFAEVMQGKPEFTDHLTHKLKHHPGQIEAAAIMEHILD</u>
<u>GSAYVKAAKKLHEMDPLQKPKQDRYALRTSPQWLGPQIEVIRAATKMIEREI</u>
<u>NSVNDNPLIDVARNKALHGGNFQGTPIGVSMDNTRLAIASIGKLMFAQFSEL</u>
<u>VNDFYNNGLPSNLSGGRNPSLDYGFKGAEIAMASYCSELQFLANPVTNHVQ</u>
<u>SAEQHNQDVNSLGLISSRKTAEAIDILKLMSSTFLVALCQAVDLRHLEENLKS</u>
<u>TVKNTVGRVARKVLMVGANGELHPSHYCERDLLKVVDREHVFTYADDACS</u>
<u>ATYPLMQKLRQVLVDQALVNGESELNPSTSIFQKIVAFEEELKAQLPKDVEG</u>
<u>VRVQYETGNLAIPNQIKECRSYPLYKLVREELGTALLTGEGVISPGEDFDKVF</u>
<u>TAICAGKLIDPLLECLS</u>GWNGAPLPIS

Figure 223: Amino Acid sequence of SeqID 503. The conserved Phenylalanine/histidine ammonia-lyase domain is underlined MEVAAAAVVAAAAAHENGNGHALPCSNGSAKPRDDPLGWGAAAESLAGS
HLEEVKRMVGEYRRPVLRLGGETLTVAQVAAAARGAGLTVELCESARPGVE
ASAEWIMESMCKGTDSYGVTTGFGATSHRRTKQGGALQKELIRFLNAGVFG
NGTESCHTLPQSATRAAMLVRVNTLLQGYSGIRFEILEALIKLVNSGITPCLPL
RGSISASGDLVPFSYIAGLLTGRPNSKAVGPAGETLTAKQAFELAGISGGFFE
LQPKEGLALVNGTGVGSALAAIVLFEANMLTVLSEVLSAIFAEVMQGKPEFT
DHLTHKLKHHPGQIEAAAIMEHILDGSSYVKAAKKLHDMDPLQKPKQDRYAL
RTSPQWLGPQVEVIRPSTKSIEREINSVNDNPLIDVSRNKALHGGNFQGTPV
GVSMDNTRLAIASIGKLMFAQFSELVNDFYNNGLPSNLSGGRNPSLDYGFK
GAEITMAAYCSELQFLANPVTNHVQSAEQHNQDVNSLGLISARKTAEAVEIL
QLMSSAFLVALCQAIDLRHLEENLKSTVKNTVSQIAKKVLTMGPNGELHPSR
FCEKDLLKVVDREHVFAYIDDPCSATYPLMQKLRQVLVDHALANGDEVKAN
SSIFLKIGTFEEELKALLPKEVDNCRSACESGNEAIPNRIRECRSYPLYKFVRA
DLGTELLTGEKVRSPGEDFDEVFTAMCEGKLIDPLLECLKEWDGPPLPIC Figure 224: Amino Acid sequence of SeqID 504. The conserved
Phenylalanine/histidine ammonia-lyase domain is underlined MDMDTAACNGKGSLGLCTGAGGDPLNWGAAAAALTGSHLDEVKRMVEES
RRPVVRLGGETLTIAQVAAIAGREAGMAVELSEAARAGVKASSDWVMESMS
KGTDSYGVTTGFGATSHRRTKQGGALQRELIRFLNAGIFGNGTESCHTLPH
SATRAAMLVRINTLLQGYSGIRFEILETMAKLLNRNITPCLPLRGTITASGDLV
PLSYIAGLLTGRPNSKAVGPNGESLNAVEAFRLAGIEHGFFDLQPKEGLALV
NGTAVGSGLASIVLYEANILAVLSEVLSAIFAEVMQGKPEFTDHLTHKLKHHP
GQIEAAAIMEHILDGSSYVKDAQKLHEMDPLQKPKQDRYALRTSPQWLGPQI
EVIRAATKMIEREINSVNDNPLIDVSRNKALHGGNFQGTPIGVSMDNTRLAIA
SIGKLMFAQFSELVNDFYNNGLPSNLSGGRNPSLDYGFKGAEIAMASYCSEL
QFLANPVTNHVQSAEQHNQDVNSLGLISSRKTAEAVDVLKLMSSTFLVALCQ
AIDLRHLEENLKSVVKNTVNQVAKKVLYVGSNGELHPSRFSEKDLIKVVDRE
YVFAYIDDPCSATYPLMQKLRQVLVDDALDDVDREKNPSTSIFQKIGTFEEEL
KALLPKEVENARAQFESGNSAIANKIRGCRSYPLYRFVREELGTGLLTGEKV
GSPGEDFDLVFSAMCEGKLIDPLLECLRDWDGAPLPIC Figure 225: Amino Acid sequence of SeqID 766. The conserved AMP dependent synthetase and ligase family domain is underlined and the AMP-binding domain signature is in bold.

```
MIEVQSAPPMARSTENENNQHDAEEGAVLNEGGMDFLYRSKLPDIDIPYHL
PLHSYCFEKLDELREKPCLIQGSNGKIYSYGEVELISRKVASGLAKLGFKKGD
VVMLLLPNCPEFVFVFLGASMAGAIATTANPFYTPSDIAKQRGASGARLIVTY
AACVEKLRDLMENHGVQVITIDNPPKGCEHISLLLDGDENEYCPADCIVQPD
DTVALPYSSGTTGLPKGVMLTHKGLVSSVAQQVDGENPNLYLHSEDVVLCV
LPLFHIYSLNSVLLCSLRAGSAILLMHKFEIGSLLDLVQRFKVTVAPVVPPIVLA
FAKNALVESYDLSSIRVVLSGAAPLGKELEDALRLRLPKATFGQGYGMTEAG
PVLSMCLAFAKEPFPMKSGSCGTVVRNAQMKIIDPDTGTCLPYNQPGEICIR
GPQIMKGYLNDAESTARTIDEDGWLHTGDIGYIDDDEEVFIVDRVKEIIKYKG
FQVPPAELEAILITHPSIADAAVVPQKDEVAGEVPVAFVVRSNGFDLTEDEIK
QFVAKQVVFYKKLHKVYFIHAIPKSPSGKILRKDLRAKLSAPTSTVEIKA
```

Figure 226: Amino Acid sequence of SeqID 769. The conserved multicopper oxidase, type 1, family domain is underlined and the conserved domains are in bold MAAVGKTSFLLGALLLFSVAVTLA**DAKVYYHDFVVQATKVKRLCTTHNTITV
NGQFPGPTLEVNDGDTLVVNVVNKARYNVTIHWHGVRQVRSGWADGPEF
VTQCPIRPGGSYTYRFTIQGQVGTLWWHAHSSWLRATVYGALVIRPKEGT
SYPFPKPKRETPILLGEWWDANPIDVVREATRTGGAPNVSDAYTINGQPGD
LYNCSSKDTVIVPIDSGETHLLRVINAALNQELFFTVANHRFTVVGADASYL
KPFTTSVIMLGPGQTTDVLISGDQPPARYYMAAEPYQSAQGAPFDNTTTTA
ILEYKSAPCPAKGISSKPVMPTLPAFNDTATVTAFIQSFRSPNKVDVPTDIDE
NLFITVGLGLFNCPKNFGSSRCQGPNGTRFTASMNNVSFVLPSNVSILQAYK
QGVPGVFTTDFPANPPVQFDYTGNVSRSLWQPVPGTKVYKLKYGSRVQIV
LQGTNIQTAENHPIHIHGYDFYILATGFGNFNPQKDTAKFNLVDPPMRNTVG
VSVNGWAVIRFVADNPGAWLMHCHLDVHITWGLAVVFLVENGV**GELQSLQ
PPPADLPPC Figure 227: HPLC analysis of sinapoyl malate in *Eucalyptus* Cald5H transgenic *fah1* plants transformed with SEQ ID NOs: 784.
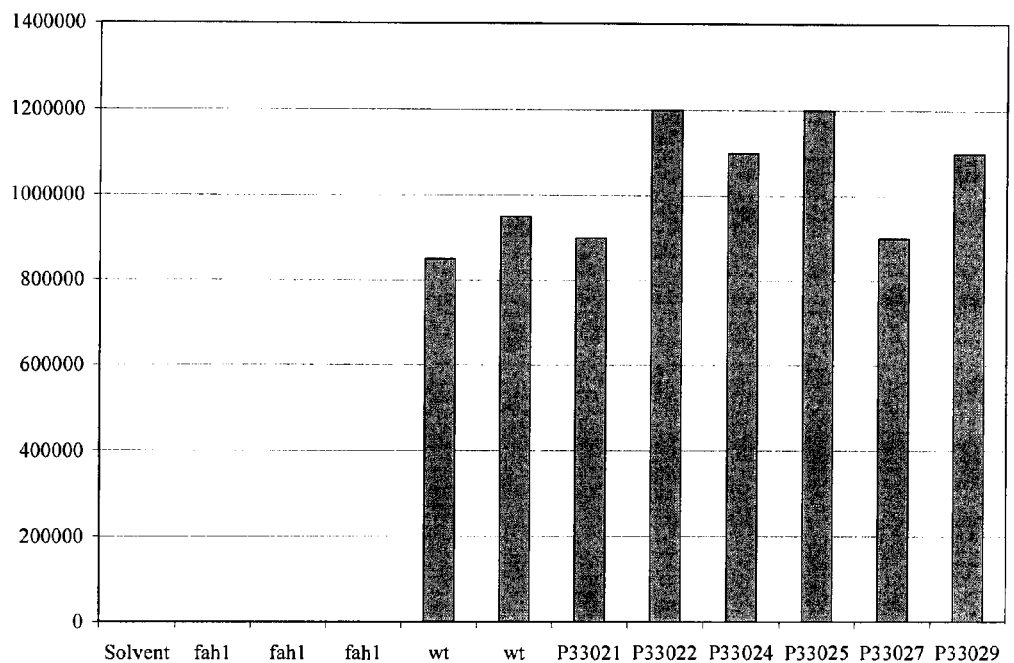

Figure 228: HPLC analysis of sinapoyl malate in *Eucalyptus* Cald5H transgenic *fah1* plants transformed with SEQ ID NOs: 785.
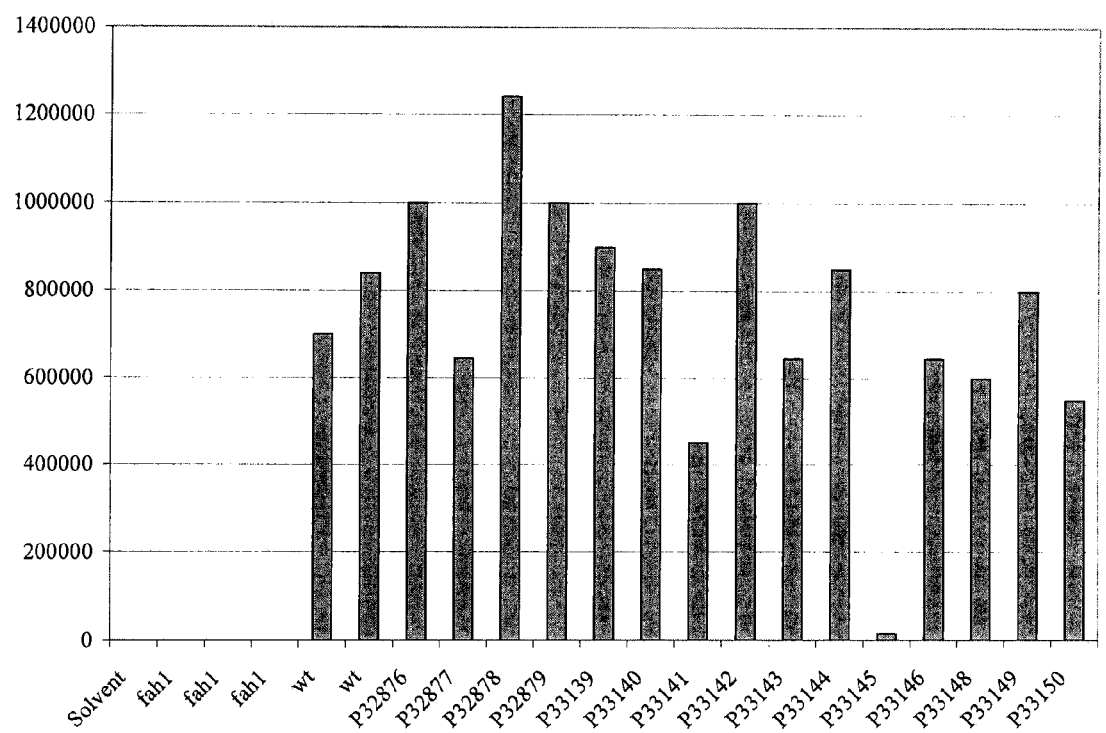

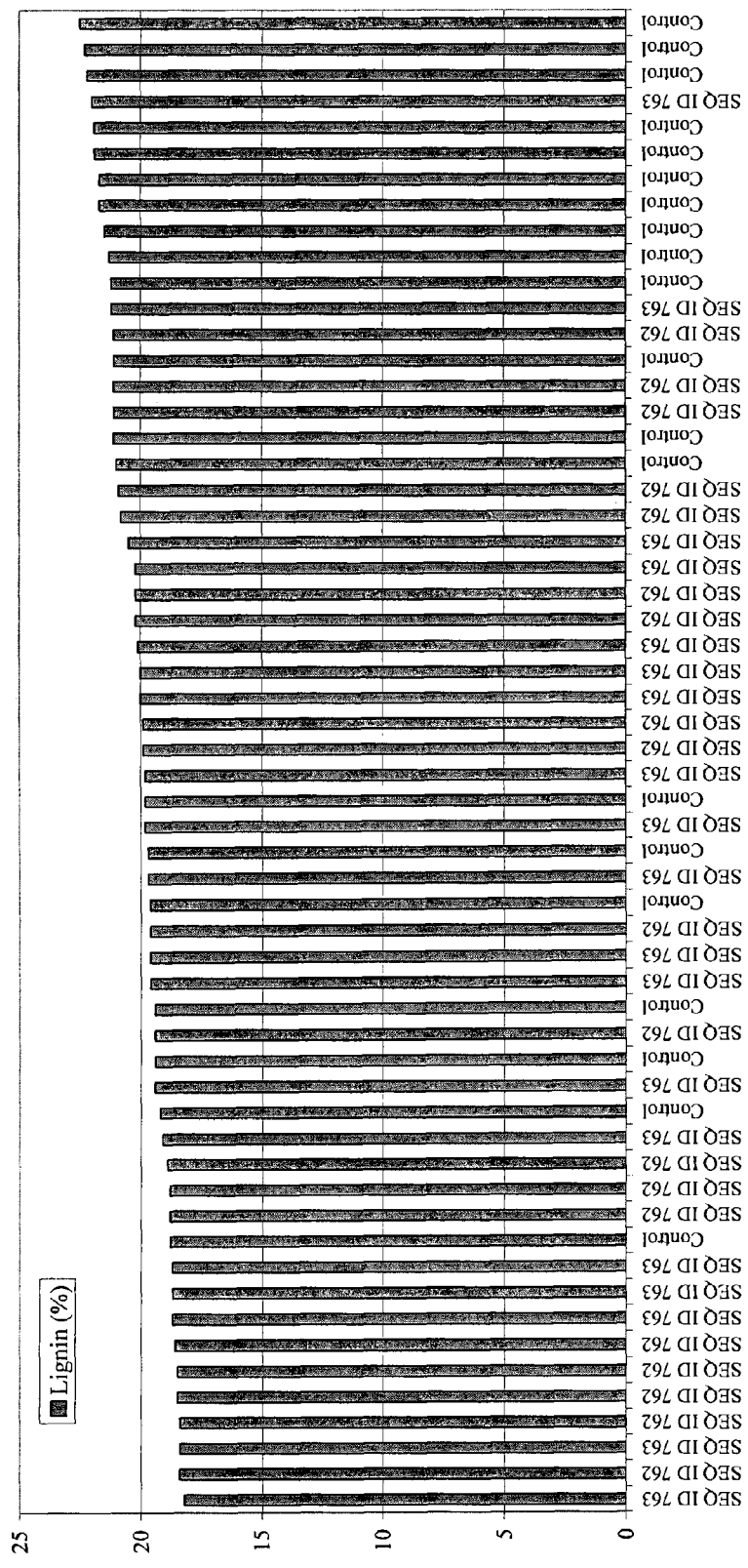
Figure 229: Fukushima and Hatfield determinations of lignin content in pARB373-, pARB460-, and control construct-transformed *E. grandis* plants.

Figure 230: The average heights and lignin content of pARB373- (SEQ ID NO: 763), pARB460- (SEQ ID NO: 762), and control construct-transformed plants.
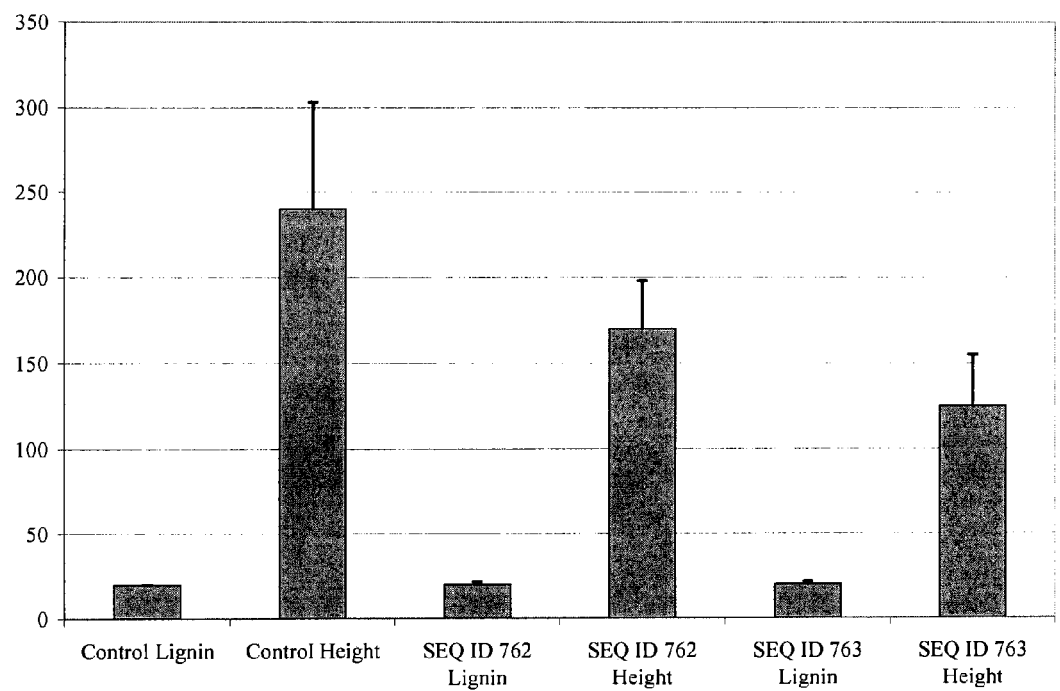

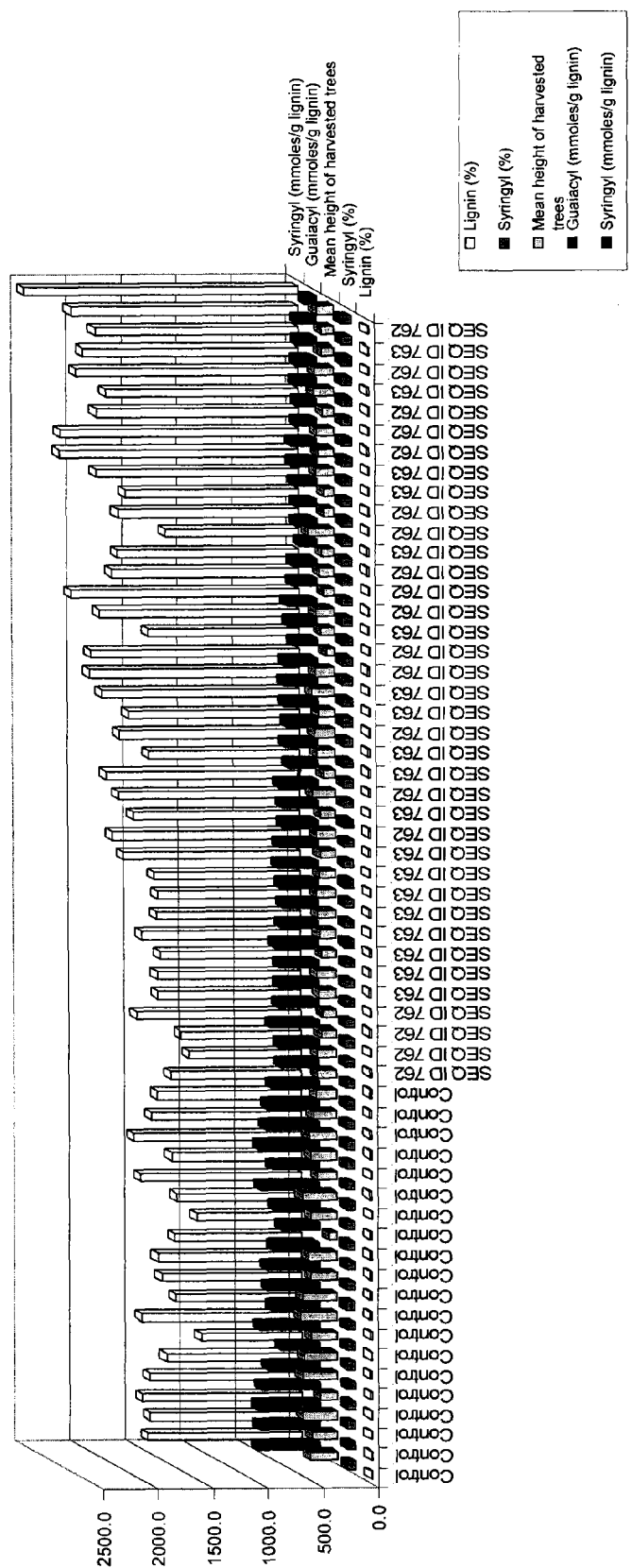
Figure 231: DFRC analysis of samples from pARB373- (SEQ ID NO: 763), pARB460- (SEQ ID NO: 762), and control construct-transformed plants.

Figure 232: Maule staining results for syringyl transformed P. taeda and controls.
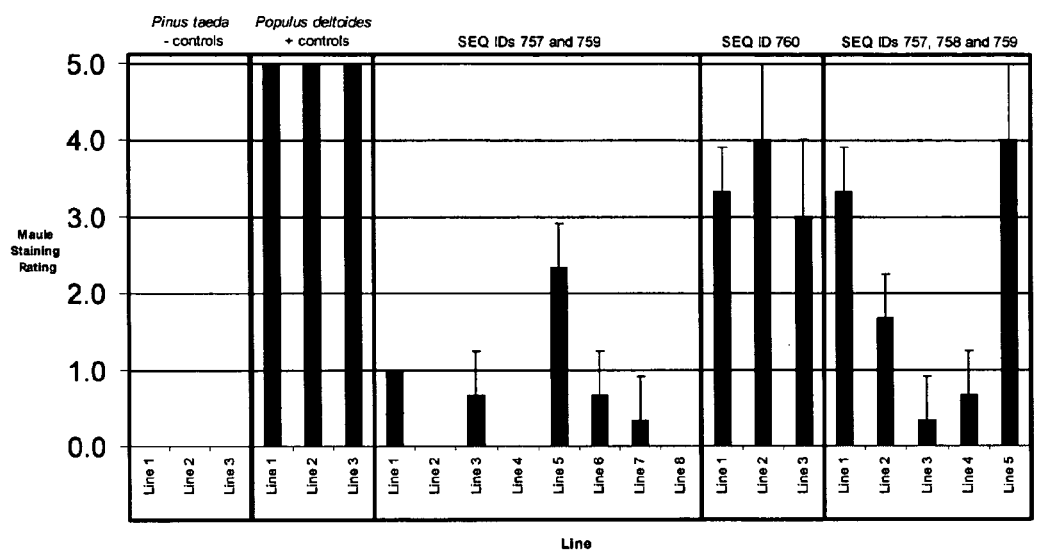

Figure 233: The analysis of plant lignin composition by pyrolysis molecular beam mass spectrometry.
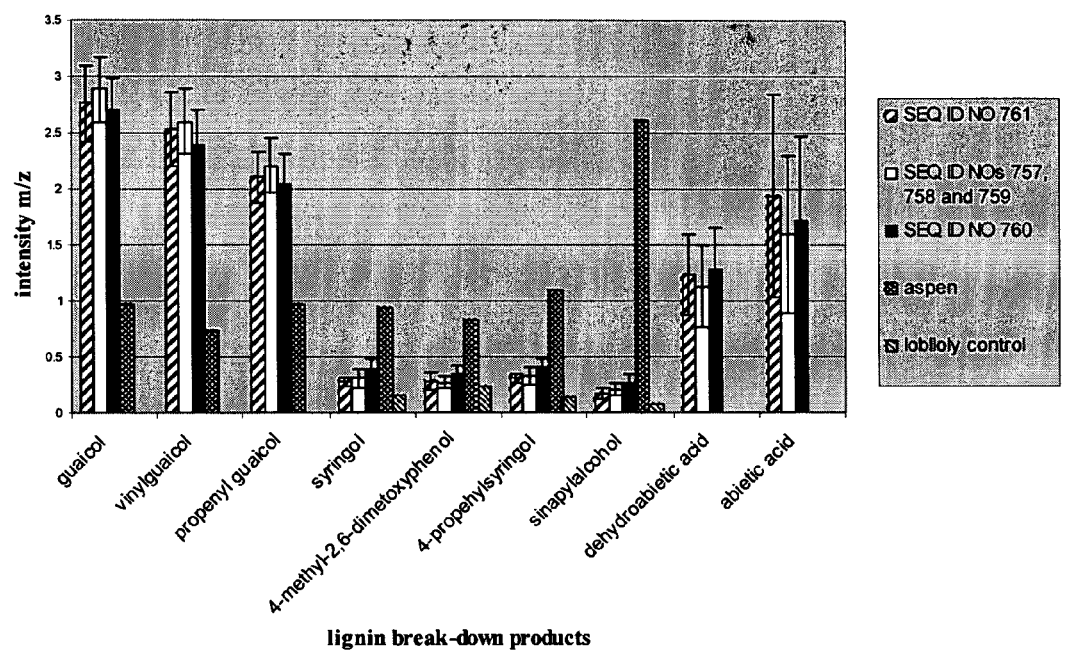

COMPOSITIONS AND METHODS FOR MODULATING LIGNIN OF A PLANT

BACKGROUND

I. Field of the Invention

The invention relates generally to the field of plant monolignol synthesis, monolignol transport, and lignin polymerization genes and polypeptides encoded by such genes, and the use of such polynucleotide and polypeptide sequences for controlling plant phenotype. The invention specifically provides polynucleotide and polypeptide sequences isolated from *Eucalyptus* and *Pinus* species and sequences related thereto.

II. Description of the Related Art

Lignin, a highly hydrophobic and crosslinked phenolic polymer, is a major component of the xylem of plants, especially woody plants such as angiosperm and gymnosperm trees. Lignin is composed of phenylpropanoid units derived from three cinnamyl alcohols, p-coumaroyl, coniferyl and sinapyl alcohol (each differing in the degree of methoxylation at the $C_3$ and $C_5$ positions of the aromic ring), although other phenolics can be incorporated. See, e.g., Sederoff et al. (1999) *Curr. Opin. Plant Biol.* 2:145-52. These alcohols are also known as monolignols.

Lignin is deposited within the cellulose framework of plant cell secondary cell walls by intussusception. The amount of ligninification varies among plant groups and species, cells and even between different parts of the same plant cell. See, e.g., T. T. Kozlowski and S. G. Pallardy (eds.), 1997, *Physiology of Woody Plants*, Academic Press, San Diego, Calif. For example, gymnosperm tracheids and angiosperm vessels are heavily lignified; whereas fiber tracheids and libriform fibers of angiosperms show little deposition of lignin. Besides its role as a structural component, lignin facilitates water transport, impedes the degradation of cell wall polysaccharides, and protects against disease-causing organisms, insects and other herbivores.

In contrast, lignin inhibits commercial exploitation of plants by impacting the structural properties of wood and wood products, as well as, the nutritional quality and digestibility of plants. Heavily lignified wood can significantly increase the cost of preparing fiber and wood products. For example, in order to make may grades of paper, it is necessary to remove much of the lignin content from the fiber network of wood. The removal of lignin during the pulping process is expensive, consumes large quantities of chemicals and energy, and potentially environmentally hazardous. Moreover, the difficulty of lignin extraction is relative to the complexity and heterogeneity of the polymer—lignin from gymnosperms, consisting mainly of guaiacyl subunits, is realatively more difficult to extract using Kraft delignification than lignin from angiosperms, consisting of both guaiacyl and syringyl subunits.

Likewise, heavily lignified plants are of poor nutritional quality as such plants generally have low levels of digestibility. As lignin is intimately associated with the cell wall polysaccharides of forages, it interferes with the digestion of those carbohydrates and hemicellulose by limiting their availability to enzymes.

The modulation of lignin content in plants by genetic engineering is an extremely powerful technique by which to ameliorate these negative plant qualities. See, e.g., Dean et al. (1997) *Adv. Biochem. Eng. Biotechnol.* 57:1-44. The control of lignin synthesis has applications such as the alteration of wood properties and, in particular, lumber and wood pulp properties. For example, wood pulp quality can be effected by increasing or decreasing the quantity or quality of lignin, cellulose, and nonlignin cell wall phenolics. Modulating lignin synthesis in a plant can also engineer functionally tailored lumber having increased or decreased dimensional stability, tensile strength, shear strength, compression strength, stiffness, hardness, spirility, shrinkage, weight, density and specific gravity.

A. The Lignification Process

The lignification process encompasses the biosynthesis of monolignols, their transport to the cell wall, and their polymerization into lignin. The lignification process has been extensively researched. However, new investigations have prompted commentators to note "that the traditional scheme of the lignin pathway is wrong in some respects." Baucher et al., *Crit. Rev. Biochem. Mol. Biol.* 38(4):305-50 (2003). Importantly, skilled artisans recognize both their "limited understanding of the chemistry and biochemistry of the plant cell walls" and their ability to predict how specific genetic modifications will influence the ligninfication process. Baucher et al., supra.

Monolignol synthesis, i.e., that of p-coumaroyl, coniferyl and sinapyl alcohols, occurs through a complex series of reactions beginning with the amino acid phenylalanine and catalyzed by a number of multifunctional enzymes. See, e.g., Boerjan et al. (2003) *Ann. Rev. Plant Biol.* 54:519-46. In brief, the lignification process begins with the deamination of phenylalanine to form cinnamic acid. Cinnamic acid is modified by hydroxylation of the ring, subsequent methoxylation, and reduction of the modified cinnamic acids to cinnamyl alcohols, the monolignol precursors for lignin.

Specifically, the proteins cinnamyl alcohol dehydrogenase (CAD), caffeoyl-CoA O-methyl-transferase (CCoAOMT), cinnamoyl-CoA reductase (CCR), cinnamic acid 4-hydroxylase (C4H), p-coumarate 3-hydroxylase (C3H), 4-coumarate:CoA ligase (4CL), caffeic acid/5-hydroxyferulic acid O-methyltransferase (COMT), ferulate 5-hydroxylase (F5H), hydroxycinnamoyl-CoA:shikimate/quinate (HCT), laccase (LAC), phenylalanine ammonia-lyase (PAL), peroxidase (POX), and sinapyl alcohol dehydrogenase (SAD), each catalyze a reaction in the lignification process. See Humphreys J. M. and C. Chapple, *Curr. Opin. Plant Biol.* 5(3):224-229 (2002).

In addition to enzymes responsible for monolignol and lignin synthesis, specific enzymes assist in the export of lignin precursors from the cell cytoplasm to the secondary cell wall. Monolignols and monolignol precursors are subsequently chemically modified to assist in transportation and storage, by an array of cellular enzymes. See, e.g., Hosokawa et al., *Plant Cell Physiol.* 42(9):959-68 (2001). For example, the enzymes coniferol glucosyl transferase (CGT) and beta-glucosidase (CBG) may assist in exportation of coniferyl alcohol and coniferin.

Likewise, following the exportation process, enzymes are needed to catalyze the final steps of the polymerization process. The formation of the lignin macromolecule results from the oxidative coupling between a monolignol and the growing lignin polymer. See, e.g., R. Hatfield and W. Vermerris (2001) *Plant Physiol.* 126:1351-57. The enzymes phenolase (PNL), peroxidase (POX), laccase (LAC also known as multicopper oxidase) and other phenol oxydases catalyze the polymerization of monolignils into lignin.

Despite the degree of knowledge of the lignification process, significant uncertainties remain. For example, little is known of the storage of monolignols before they are transported to the cell wall. Similarly, skilled artisans generally do not know the subcellular localizations of most enzymes which catalyze lignification. Moreover, as discussed above, revisions of the lignification process have recently occurred as the result of new invesitigations into enzyme substate specificity and kinetics. Accordingly, new techniques are needed to investigate the role of specific enzymes in the lignification process.

B. Genetic Engineering of Plant Lignin Content

Previously, researchers have attempted to modulate the lignin content through the construction of transgenic plants. See, e.g., Baucher et al., supra. Although this research confirmed some of the recent revisions of the lignification process, it "has also opened up new research areas" and "posed new questions" for lignin research.

1. Up- and Down-Regulation of PAL

PAL catalyzes the non-oxidative deamination of phenylalanine to cinnamic acid. As this is the first step of the phenylpropanoid pathway, the reduction of PAL activity leads to a wide variety of abnormal phenotypes. See Elkind et al., *Proc. Natl. Acad. Sci. U.S.A.* 87:9057-9061 (1990). Transgenic tobacco plants were stunted, had abnormal leaves, reduced lignin content, and high incidence of fungal infection than wild-type plants. See Elkind et al., supra; Maher et al., *Proc. Natl. Acad. Sci. U.S.A.* 91:7802-7806 (1994).

2. Up- and Down-Regulation of C4H

Hydroxylation of cinnamic acid is catylzyed by C4H, a cytochrome P450-linked monooxygenase. In transgenic tobacco plants, overexpression of C4H had no effect on lignin content nor composition. See Sewalt et al., *Plant Physiol.* 115:41-50 (1997). In contrast, down-regulation of C4H led to decrease lignin content and altered lignin composition. See Sewalt et al., supra.

3. Down-Regulation of OMT

Transgenic plants which down-regulate OMT have been produced. See Zhong et al., *Plant Physiol.* 124:536-577 (2000). These plants demonstrated decreased lignin content primarily due to the reduction of both guaiacyl and syringyl subunits. Additionally, although the transgenic poplar were not affected in either growth or morphology, its lignin was much less cross-linked that wild-type poplar.

4. Up- and Down-Regulation of F5H

F5H was renamed coniferaldehyde 5-hydroxylase (Cald5H) upon the realization that it preferentially catalyzes the 5-hydroxylation of the cinnammaldehydes. See Baucher et al., supra. An *Arabidopis* mutant deficient in F5H reportedly produced lignin deficient in syringyl subunits. See Chapple et al., *Plant Cell* 4:1413-1424 (1992). Likewise, overexpression of a heterologous isoform of F5H in aspen produced an altered lignin compostition but failed to impact lignin content.

5. Down-Regulation of 4CL

Transgenic plants with reduced 4CL activity have been produced in aspen. See Hu et al., *Nature Biotechnol.* 17:808-812 (1999). Although these transgenic plants had decreased lignin content, normal cellular morphology and an increased growth rate, the apsens did not show any difference in the lignin composition. Additionally, the transgenic aspens possessed an increase in the amount of nonlignin cell wall phenolics.

6. Down-Regulation of CCR

CCR catalyzes a potential control point in the lignification process, namely the reduction of hydroxycinnamoyl-CoA thioesters to the corresponding aldehydes. Trangenic tobacco plants with down-regulated CCR activity demonstrated reduced lignin content and abnormal phenotypes, such as collapsed vessels, stunted growth, and abnormal leaf development. See, e.g., Goujon et al., *Planta* 217:218-228 (2003).

7. Down-Regulation of CAD

CAD catalyzes the final step of monolignal synthesis, i.e., the reduction of cinnamaldehydes to cinnamyl alcohols, and cad mutant plants and genetically-modified plants have been studied. An unusal cad mutant pine possessed an altered lignin composition, even to the extent of incorporating an unusual phenolic monomer. See Ralph et al., *Science* 277: 235-239 (1997). Although the lignin of plants with low CAD activity is more extractable in alkali (see, e.g., Halpin et al., *Plant J.* 6:339-350 (1994)), lignin content is only slightly effected by the down-regulation of CAD activity (see Pilate et al., *Nature Biotechnol.* 20:607-612 (2002)).

8. Up- and Down-Regulation of Peroxidases

Peroxidases are believed to catalize the polymerization of lignin, yet no definitive proof have been presented for the involvement of any specific isozyme in vivo. See Baucher et al., supra. This is mainly due to both the large number of genes which encode peroxidases and the low substrate specificity of peroxidases. Although no change in lignin content and composition was observed in transgenic tobacco plants deficient in a major anionic peroxidase (see Lagrimini et al., *Plant Physiol.* 114:1187-1196 (1997)), a transgenic poplar with reduced anionic peroxidase activity demonstrated some reduced lignin content and altered lignin composition (see Yahong et al., In *Molecular Breeding of Woody Plants* (Progress in Biotechnology Series, Vol. 18), Elsevier Science, Amsterdam (2001)). Likewise, overexpression of peroxidase genes in poplar produced poor results, with no effect on overall plant phenotype or lignin content. See, e.g., Christensen et al., *Plant Mol. Biol.* 47:581-593 (2001).

9. Down-Regulation of Laccases

The role of laccases in the lignification process is still very much unclear. It is believed laccases participate in lignin polymerization. See, e.g., McDougall et al., Planta 194:9-14 (1994). However, transgenic *Liriodendron* (see Dean et al., In *Lignin and Lignan Biosynthesis* (ACS Symposium Series, Vol. 697), American Chemical Society, Washington, D.C.) and poplar (see Ranocha et al., *Plant Physiol.* 129:145-155 (2002)) down-regulating laccase had no altered phenotype nor any change in lignin content or composition.

As described above, many different transgenic plants are now available with altered lignin content, altered lignin composition or structure, or both. However, these experiments have few identified transgenic plants with distinct advantages in industrial operations, such as commercial pulping and papermaking. Additionally, these widely-divergent experimental results demonstrate the uncertainty apparent in the attempted modulation of the lignification process in transgenic plants.

C. Expression Profiling and Microarray Analysis of Monolignol Synthesis, Monolignol Transport, and Lignin Polymerization The multigenic control of the lignification process presents difficulties in determining the genes responsible for phenotypic determination. One major obstacle to identifying genes and gene expression differences that contribute to phenotype in plants is the difficulty with which the expression of more than a handful of genes can be studied concurrently. Another difficulty in identifying and understanding gene expression and the interrelationship of the genes that contribute to plant phenotype is the high degree of sensitivity to environmental factors that plants demonstrate.

There have been recent advances using genome-wide expression profiling. In particular, the use of DNA microarrays has been useful to examine the expression of a large number of genes in a single experiment. Several studies of plant gene responses to developmental and environmental stimuli have been conducted using expression profiling. For example, microarray analysis was employed to study gene expression during fruit ripening in strawberry, Aharoni et al., *Plant Physiol.* 129:1019-1031 (2002), wound response in *Arabodopsis*, Cheong et al., *Plant Physiol.* 129:661-7 (2002), pathogen response in *Arabodopsis*, Schenk et al., *Proc. Nat'l Acad. Sci.* 97:11655-60 (2000), and auxin response in soybean, Thibaud-Nissen et al., *Plant Physiol.* 132:118. Whetten et al., *Plant Mol. Biol.* 47:275-91 (2001) discloses expression profiling of cell wall biosynthetic genes in *Pinus taeda* L. using cDNA probes. Whetten et al. examined genes which were differentially expressed between differentiating juvenile and mature secondary xylem. Additionally, to determine the effect of certain environmental stimuli on gene expression, gene expression in compression wood was compared to normal wood. 156 of the 2300 elements examined showed differential expression. Whetten, supra at 285. Comparison of juvenile wood to mature wood showed 188 elements as differentially expressed. Id. at 286.

Although expression profiling and, in particular, DNA microarrays provide a convenient tool for genome-wide expression analysis, their use has been limited to organisms for which the complete genome sequence or a large cDNA collection is available. See Hertzberg et al., *Proc. Nat'l Acad. Sci.* 98:14732-7 (2001a), Hertzberg et al., *Plant J.,* 25:585 (2001b). For example, Whetten, supra, states, "A more complete analysis of this interesting question awaits the completion of a larger set of both pine and poplar ESTs." Whetten et al. at 286. Furthermore, microarrays comprising cDNA or EST probes may not be able to distinguish genes of the same family because of sequence similarities among the genes. That is, cDNAs or ESTs, when used as microarray probes, may bind to more than one gene of the same family.

Methods of manipulating gene expression to yield a plant with a more desirable phenotype would be facilitated by a better understanding of monolignol synthesis, monolignol transport, and lignin polymerization gene expression in various types of plant tissue, at different stages of plant development, and upon stimulation by different environmental cues. The ability to control plant architecture and agronomically important traits would be improved by a better understanding of how monolignol synthesis, monolignol transport, and lignin polymerization gene expression effects formation of plant tissues and how plant growth and the lignification process are connected. Among the large number of genes, the expression of which can change during development of a plant, only a fraction are likely to effect phenotypic changes during any given stage of the plant development.

SUMMARY

In one embodiment, DNA constructs useful for modulating the expression of monolignol synthesis, monolignol transport, and lignin polymerization are provided. In another embodiment, methods of modulating the expression lignin in plants are provided. In another embodiment, methods of making wood and wood pulp are provided. In addition, plant cells and plants that comprise DNA constructs useful for modulating the expression monolignol synthesis, monolignol transport, and lignin polymerization are provided.

In one embodiment, a polynucleotide comprises any one of the sequences of SEQ ID NOs: 1-252, 765 and 768, and conservative variants thereof. In one embodiment, the polynucleotide has a sequence identical to a gene sequence expressed in either *Eucalyptus* or *Pinus* species. In another embodiment, the convservative variant has a sequence identity that is greater than or equal to 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, 75%, 74%, 73%, 72%, 71%, 70%, 69%, 68%, 67%, 66%, 65%, 64%, 63%, 62%, 61%, 60%, to any one of SEQ ID NOs: 1-252, 756 and 768. In another embodiment, such a conservative variant would further encode a protein possessing the activity of the protein of any one of SEQ ID NOs: 1-252, 756 and 768.

In another emobiment, a DNA construct comprises at least one of the polynucleotides of SEQ ID NOs: 1-252, 765 and 768. In yet another embodiment, a DNA construct comprises at least one of the polynucleotides of SEQ ID NOs: 1-252, 765 and 768, and an operably-linked promoter. In another embodiment, the DNA construct further comprises an operably-linked intron.

In one embodiment, the promoter can be a constitutive promoter, a strong promoter, an inducible promoter, a regulatable promoter, a temporally regulated promoter, and a preferred promoter. In another embodiment, the promoter can more specifically be an arabinogalactan gene family promoter, cinnamate 4-hydroxylase gene family promoter, nopaline synthase promoter, octopine synthase promoter, O-Methyltransferase gene family promoter, LIM protein gene family promoter, superubiquitin gene family promoter, and ubiquitin gene family promoter, and promoters for isozymes thereof. In yet another embodiment, the promoter can be the *Arabidopsis* ubiquitin 3 promoter, *Arabidopsis* ubiquitin 10 promoter, *Arabidopsis* ubiquitin 11 promoter, cauliflower mosaic virus 35S promoter, *Eucalyptus* Arabinogalactan promoter, *Eucalyptus* caffeic acid o-methyltransferase promoter, *Pinus* 4-coumarate CoA ligase promoter, *Pinus* cinnamate 4-hydroxylase promoter, *Pinus* LIM protein promoter, and *Pinus* superubiquitin promoter.

In one embodiment, the intron can be selected from a *Eucalyptus* xylem intron, PDK intron, superubiquitin intron, and YABBY intron.

In another embodiment, the polynucleotide encodes an RNA transcript. In one embodiment, the polynucleotide is in a sense or antisense orientation relative to the promoter. In yet another embodiment, the RNA transcript induces RNA interference of a polynucleotide having a nucleic acid sequence selected from the group consisting of SEQ ID NOs: 1-252, 765 and 768.

In one embodiment, a plant cell transformed with DNA constructs is provided. In another embodiment, a transgenic plant comprising the transformed plant cell are provided. In one embodiment, the transformed plant is a woody plant. In another embodiment, the transformed plant is a tree. In yet another embodiment, the transformed plant is of a species of *Eucalyptus* or *Pinus*. In one embodiment, the plant may exhibit one or more traits, such as increased drought tolerance, herbicide resistance, reduced or increased height, reduced or increased branching, enhanced cold and frost tolerance, improved vigor, enhanced or altered color, enhanced health and nutritional characteristics, improved storage, enhanced yield, enhanced salt tolerance, enhanced resistance of the wood to decay, enhanced resistance to fungal diseases, altered attractiveness to insect pests, increased disease tolerance, increased insect tolerance, increased water-stress'tolerance, improved texture, increased germination, increased micronutrient uptake, production of novel resins, and production of novel proteins or peptides, as compared to a plant of the same species that has not been transformed with the DNA construct. In another embodiment, the plant may exhibit one or more traits, such as a reduced period of juvenility, an increased period of juvenility, propensity to form reaction wood, self-absicising branches, accelerated reproductive development or delayed reproductive development, as compared to a plant of the same species that has not been transformed with the DNA construct.

In one embodiment, methods of making a transformed plant are provided. In another embodiment, methods of making a transformed plant are provided in which a phenotype of the transformed plant is different from a phenotype of a plant of the same species that has not been transformed with the DNA construct. In one embodiment, the phenotype of the transformed plant is lignin content, lignin composition, wood composition, wood appearance, wood density, wood strength, wood stiffness, cellulose polymerization, fiber dimensions, lumen size, proportion of rays, proportion of vessel elements, plant cell division, plant cell development, number of cells per unit area, cell size, cell shape, cell wall composition, rate of wood formation, aesthetic appearance of wood, formation of stem defects, average microfibril angle, width of the S2 cell wall layer, accumulation of nonlignin cell wall phenolics, rate of growth, rate of root formation ratio of root to branch vegetative development, leaf area index, and leaf shape. In another embodiment, the phenotype that is different is increased or decreased relative percentage of the p-hydroxyphenyl subunit, increased or decreased relative percentage of the guaiacyl subunit, increased or decreased relative percentage of the sinapyl subunit, and an increased or decreased syringyl-to-guaiacyl ratio. In another embodiment, the phenotype that is different is the production and incorporation of syringyl monomer in lignin, and wherein the wild-type plant is characterized by lignin with little to no syringyl monomers.

In one embodiment, there is provided an isolated polynucleotide comprising a sequence encoding the catalytic or substrate-binding domain of a polypeptide of any one of SEQ ID NOs: 253-504, 766 and 769, in which the polynucleotide encodes a polypeptide having the activity of effecting monolignol synthesis, monolignol transport, or lignin polymerization. In another embodiment, an isolated polynucleotide is provided which comprises a sequence encoding the catalytic or substrate-binding domain of a polypeptide of any one of SEQ ID NOs: 253-504, 766 and 769, in which the polynucleotide encodes a polypeptide having the activity of the polypeptide of SEQ ID NOs: 253-504, 766 and 769.

In one embodiment, methods of making a transformed plant are provided comprising transforming a plant cell with a DNA construct having at least one polynucleotide of SEQ ID NOs: 1-252, 765 and 768, and their conservative variants, and culturing the transformed plant cell under conditions that promote growth of a plant. In another embodiment, the DNA construct transforming the plant cell comprises a promoter operably-linked to the polynucleotide. In another embodiment, the DNA construct transforming the plant cell further comprises an intron, and in which the promoter, polynucleotide, and intron are operably-linked. In another embodiment, the DNA construct transforming the plant cell comprises a polynucleotide encoding a polypeptide having an activity effecting monolignol synthesis, monolignol transport or lignin polymerization. In another embodiment, the DNA construct transforming the plant cell comprises a polynucleotide encoding a polypeptide having at least one activity, such as caffeate O-methyltransferase, caffeoyl-CoA O-methyltransferase, cinnamoyl-CoA reductase, trans-cinnamate 4-monooxygenase, coniferyl-alcohol glucosyltransferase, coniferin beta-glucosidase, coniferyl alcohol dehydrogenase, para-coumarate 3-monooxygenase, 4-coumarate CoA ligase, ferrulate 5-monooxygenase, laccase, mannitol dehydrogenase, peroxidase, and phenylalanine ammonia-lyase. In one embodiment, the methods comprise plant cells located within plant explant tissue.

In one embodiment, methods of making a transformed plant are provided, in which the phenotype is different in the transformed plant, as compared to a wild-type plant of the same species, when comparing, for instance, lignin content, lignin composition, wood composition, wood appearance, wood density, wood strength, wood stiffness, cellulose polymerization, fiber dimensions, lumen size, proportion of rays, proportion of vessel elements, plant cell division, plant cell development, number of cells per unit area, cell size, cell shape, cell wall composition, rate of wood formation, aesthetic appearance of wood, formation of stem defects, average microfibril angle, width of the S2 cell wall layer, accumulation of nonlignin cell wall phenolics, rate of growth, rate of root formation ratio of root to branch vegetative development, leaf area index, and leaf shape. In another embodiment, a phenotype that is different in the transformed plant, as compared to a wild-type plant of the same species, is a lignin modification such as increased or decreased relative percentage of the p-hydroxyphenyl subunit, increased or decreased relative percentage of the guaiacyl subunit, increased or decreased relative percentage of the sinapyl subunit, and an increased or decreased syringyl-to-guaiacyl ratio. In another embodiment, the phenotype that is different in the transformed plant, as compared to a wild-type plant of the same species, is the production and incorporation of syringyl monomer in lignin, and in which the wild-type plant is characterized by lignin incorporating little to no syringyl monomers.

In one embodiment, methods of making a transformed plant are provided in which a phenotype that is different in the transformed plant, as compared to a wild-type plant of the same species, is modified by increased drought tolerance, herbicide resistance, reduced or increased height, reduced or increased branching, enhanced cold and frost tolerance, improved vigor, enhanced or altered color, enhanced health and nutritional characteristics, improved storage, enhanced yield, enhanced salt tolerance, enhanced resistance of the wood to decay, enhanced resistance to fungal diseases, altered attractiveness to insect pests, increased disease tolerance, increased insect tolerance, increased water-stress tolerance, improved texture, increased germination, increased micronutrient uptake, production of novel resins, and production of novel proteins or peptides, as compared to a plant of the same species that has not been transformed with the DNA construct. In another embodiment, the phenotype that is different in the transformed plant, as compared to a wild-type plant of the same species, is modified by a reduced period of juvenility, an increased period of juvenility, propensity to form reaction wood, self-abscising branches, accelerated reproductive development or delayed reproductive development, as compared to a plant of the same species that has not been transformed with the DNA construct.

In one embodiment, wood is provided which has been obtained from a transgenic tree which has been transformed by an inventive DNA construct. In another embodiment, the wood comprises an altered, as compared to wood obtained from a wild-type plant of the same species, trait such as lignin content, lignin composition, wood composition, wood appearance, wood density, wood strength, wood stiffness, cellulose polymerization, fiber dimensions, lumen size, proportion of rays, proportion of vessel elements, plant cell division, plant cell development, number of cells per unit area, cell size, cell shape, cell wall composition, rate of wood formation, aesthetic appearance of wood, formation of stem defects, average microfibril angle, width of the S2 cell wall layer, accumulation of nonlignin cell wall phenolics, rate of growth, rate of root formation ratio of root to branch vegetative development, leaf area index, and leaf shape. In another embodiment, the wood comprises an altered trait such as increased or decreased relative percentage of the p-hydroxyphenyl subunit, increased or decreased relative percentage of the guaiacyl subunit, increased or decreased relative percentage of the sinapyl subunit, and an increased or decreased syringyl-to-guaiacyl ratio. In another embodiment, the wood comprises lignin of an altered S/G ratio, as compared to wood from a wild-type plant, such as an increased S/G ratio and a decreased S/G ratio. In another embodiment, the wood degrades faster than that of wood from a wild-type plant or more efficiently undergoes delignification than wood from a wild-type plant. In another embodiment, the wood comprises lignin possessing the syringyl subunit but in which the wild-type plant is characterized by lignin with little to no syringyl monomers.

In one embodiment, methods of making wood are provided comprising transforming a plant with a DNA construct comprising a polynucleotide having a nucleic acid sequence selected from the group consisting of SEQ ID NOs: 1-252, 765 and 768, and conservative variants thereof, culturing the transformed plant under conditions that promote growth of a plant; and obtaining wood from the plant.

In another embodiment, wood pulp is provided which has been obainted from a transgenic tree transformed with the inventive DNA constructs.

In one embodiment, methods of making wood pulp are provided comprising transforming a plant with an inventive DNA construct; culturing the transformed plant under conditions that promote growth of a plant; and obtaining wood pulp from the plant. In another embodiment, the wood pulp is obtained from the plant by any pulping process, such as mechanical pulping, thermomechanical pulping, enzymatic pulping, chemical pulping, or chemithermomechanical pulping. In another embodiment, chemical pulping processing can consist of acidic or bisulfate pulping, sulfate pulping, Kraft pulping, soda pulping, anthraquinone pulping, or Kraft-anthraquinone pulping.

In one embodiment, polypeptide comprising an amino acid sequence encoded by the inventive isolated polynucleotides are provided. In another embodiment, isolated polypeptides are provided comprising amino acid sequences such as SEQ ID NOs: 253-504, 766 and 769.

In another embodiment, methods of altering a phenotype of a plant are provided comprising altering expression in the plant of a polypeptide encoded by any one of SEQ ID NOs: 253-504, 766 and 769. In another embodiment, the expression in a plant can be up-regulated, down-regulated, silenced, or developmentally-regulated. In another embodiment, the method of altering expression takes place in a woody plant. In another embodiment, the altered plant phenotype is a trait such as lignin content, lignin composition, wood composition, wood appearance, wood density, wood strength, wood stiffness, cellulose polymerization, fiber dimensions, lumen size, proportion of rays, proportion of vessel elements, plant cell division, plant cell development, number of cells per unit area, cell size, cell shape, cell wall composition, rate of wood formation, aesthetic appearance of wood, formation of stem defects, average microfibril angle, width of the S2 cell wall layer, accumulation of nonlignin cell wall phenolics, rate of growth, rate of root formation ratio of root to branch vegetative development, leaf area index, and leaf shape. In another embodiment, the plant exhibits one or more traits such as increased drought tolerance, herbicide resistance, reduced or increased height, reduced or increased branching, enhanced cold and frost tolerance, improved vigor, enhanced color, enhanced health and nutritional characteristics, improved storage, enhanced yield, enhanced salt tolerance, enhanced resistance of the wood to decay, enhanced resistance to fungal diseases, altered attractiveness to insect pests, increased disease tolerance, increased insect tolerance, increased water-stress tolerance, improved texture, increased germination, increased micronutrient uptake, production of novel resins, increased cellulose content, decreased lignin content and production of novel proteins or peptides, as compared to a plant of the same species that has not been transformed with the DNA construct.

In one embodiment, methods of altering a phenotype of a plant are provided in which the plant possesses lignin having one or more traits such as increased or decreased relative percentage of the p-hydroxyphenyl subunit, increased or decreased relative percentage of the guaiacyl subunit, increased or decreased relative percentage of the sinapyl subunit, and an increased or decreased syringyl-to-guaiacyl ratio. In another embodiment, the lignin has an altered S/G ratio, as compared to wood from a wild-type plant, such as an increased S/G ratio and a decreased S/G ratio.

In one embodiment, a polynucleotide is provided comprising a nucleic acid sequence selected from the group consisting of SEQ ID NOs: 505-756, 767 and 770.

In another aspect, the present invention provides method of correlating gene expression in two different samples, comprising detecting a level of expression of one or more genes encoding a product encoded by a nucleic acid sequence selected from the group consisting of SEQ ID NOs: 1-252, 765 and 768 and conservative variants thereof in a first sample, detecting a level of expression of the one or more genes in a second sample, comparing the level of expression of the one or more genes in the first sample to the level of expression of the one or more genes in the second sample, and correlating a difference in expression level of the one or more genes between the first and second samples.

In a further aspect, the present invention provides a method of correlating the possession of a plant phenotype to the level of gene expression in the plant of one or more genes comprising detecting a level of expression of one or more genes encoding a product encoded by a nucleic acid sequence selected from the group consisting of SEQ ID NOs: 1-252, 765 and 768 and conservative variants thereof in a first plant possessing a phenotype, detecting a level of expression of the one or more genes in a second plant lacking the phenotype, comparing the level of expression of the one or more genes in the first plant to the level of expression of the one or more genes in the second plant, and correlating a difference in expression level of the one or more genes between the first and second plants to possession of the phenotype.

In an additional aspect, the invention provides a method of correlating gene expression to propensity to form reaction wood, comprising detecting a level of expression of one or more genes encoding a product encoded by a nucleic acid sequence selected from the group consisting of SEQ ID NOs: 1-252, 765 and 768 and conservative variants thereof in a first plant cell in xylem displaying a normal wood phenotype, detecting a level of expression of the one or more genes in a second plant cell in xylem displaying a reaction wood phenotype, comparing the level of the expression of the one or more genes in the first plant cells to the level of expression of the one or more genes in the second plants cells, and correlating a difference in expression level of the one or more genes between the first and second samples to the propensity to form reaction wood.

In one aspect, the present invention provides a combination for detecting expression of one or more genes, comprising two or more oligonucleotides, wherein each oligonucleotide is capable of hybridizing to a nucleic acid sequence selected from the group consisting of SEQ ID NOs: 1-252, 765 and 768.

In another aspect, the present invention provides a combination for detecting expression of one or more genes, comprising two or more oligonucleotides, wherein each oligonucleotide is capable of hybridizing to gene product encoded by a nucleic acid sequence selected from the group consisting of SEQ ID NOs: 1-252, 765 and 768.

In a further aspect, the present invention provides a microarray comprising a combination of the present invention on a solid support, wherein each of said two or more oligonucleotides occupies a unique location on said solid support.

In an additional aspect, the present invention provides a method for detecting one or more genes in a sample, comprising contacting the sample with two or more oligonucleotides, wherein each oligonucleotide is capable of hybridizing to a gene comprising a nucleic acid sequence selected from the group consisting of SEQ ID NOs: 1-252, 765 and 768 under standard hybridization conditions and detecting the one or more genes of interest which are hybridized to the one or more oligonucleotides.

In one aspect, the present invention provides a method for detecting one or more nucleic acid sequences encoded by one or more genes in a sample, comprising contacting the sample with two or more oligonucleotides, wherein each oligonucleotide is capable of hybridizing to a nucleic acid sequence encoded by a gene comprising a nucleic acid sequence selected from the group consisting of SEQ ID NOs: 1-252, 765 and 768 under standard hybridization conditions and detecting the one or more nucleic acid sequences which are hybridized to the one or more oligonucleotides.

In one aspect, the present invention provides a kit for detecting gene expression comprising a microarray together with one or more buffers or reagents for a nucleotide hybridization reaction.

Other objects, features and advantages of the present invention will become apparent from the following detailed description. The detailed description and specific examples, while indicating preferred embodiments, are given for illustration only since various changes and modifications within the spirit and scope of the invention will become apparent to those skilled in the art from this detailed description. Further, the examples demonstrate the principle of the invention and cannot be expected to specifically illustrate the application of this invention to all the examples where it will be obviously useful to those skilled in the prior art.

BRIEF DESCRIPTION OF THE DRAWINGS

FIG. 1: Amino acid sequence as depicted in SEQ ID NO: 268. The conserved glycoside hydrolase, family 1, domain is underlined and the glycosyl hydrolases family 1 active site is in bold.

FIG. 2: Amino acid sequence as depicted in SEQ ID NO: 269. The conserved glycoside hydrolase, family 1, domain is underlined and the glycosyl hydrolases family 1 N-terminal signature is in bold.

FIG. 3: Amino acid sequence as depicted in SEQ ID NO: 270. The conserved glycoside hydrolase, family 1, domain is underlined and the glycosyl hydrolases family 1 N-terminal signature is in bold.

FIG. 4: Amino acid sequence as depicted in SEQ ID NO: 271. The conserved glycoside hydrolase, family 1, domain is underlined and the glycosyl hydrolases family 1 N-terminal signature is in bold.

FIG. 5: Amino acid sequence as depicted in SEQ ID NO: 272. The conserved glycoside hydrolase, family 1, domain is underlined and the glycosyl hydrolases family 1 N-terminal signature is in bold.

FIG. 6: Amino acid sequence as depicted in SEQ ID NO: 273. The conserved glycoside hydrolase, family 1, domain is underlined and the glycosyl hydrolases family 1 N-terminal signature is in bold.

FIG. 7: Amino acid sequence as depicted in SEQ ID NO: 274. The conserved zinc-containing alcohol dehydrogenase superfamily domain is underlined and the zinc-containing alcohol dehydrogenases signature is in bold.

FIG. 8: Amino acid sequence as depicted in SEQ ID NO: 275. The conserved zinc-containing alcohol dehydrogenase superfamily domain is underlined and the zinc-containing alcohol dehydrogenases signature is in bold.

FIG. 9: Amino acid sequence as depicted in SEQ ID NO: 276. The conserved zinc-containing alcohol dehydrogenase superfamily domain is underlined and the zinc-containing alcohol dehydrogenases signature is in bold.

FIG. 10: Amino acid sequence as depicted in SEQ ID NO: 277. The conserved zinc-containing alcohol dehydrogenase superfamily domain is underlined and the zinc-containing alcohol dehydrogenases signature is in bold.

FIG. 11: Amino acid sequence as depicted in SEQ ID NO: 278. The conserved zinc-containing alcohol dehydrogenase superfamily domain is underlined and the zinc-containing alcohol dehydrogenases signature is in bold.

FIG. 12: Amino acid sequence as depicted in SEQ ID NO: 279. The conserved UDP-glucoronosyl/UDP-glucosyl transferase family domain is underlined and the UDP-glycosyltransferases signature is in bold.

FIG. 13: Amino acid sequence as depicted in SEQ ID NO: 280. The conserved UDP-glucoronosyl/UDP-glucosyl transferase family domain is underlined and the UDP-glycosyltransferases signature is in bold.

FIG. 14: Amino acid sequence as depicted in SEQ ID NO: 281. The conserved UDP-glucoronosyl/UDP-glucosyl transferase family domain is underlined and the UDP-glycosyltransferases signature is in bold.

FIG. 15: Amino acid sequence as depicted in SEQ ID NO: 282. The conserved UDP-glucoronosyl/UDP-glucosyl transferase family domain is underlined and the UDP-glycosyltransferases signature is in bold.

FIG. 16: Amino acid sequence as depicted in SEQ ID NO: 283. The conserved UDP-glucoronosyl/UDP-glucosyl transferase family domain is underlined and the UDP-glycosyltransferases signature is in bold.

FIG. 17: Amino acid sequence as depicted in SEQ ID NO: 284. The conserved UDP-glucoronosyl/UDP-glucosyl transferase family domain is underlined and the UDP-glycosyltransferases signature is in bold.

FIG. 18: Amino acid sequence as depicted in SEQ ID NO: 285. The conserved UDP-glucoronosyl/UDP-glucosyl transferase family domain is underlined and the UDP-glycosyltransferases signature is in bold.

FIG. 19: Amino acid sequence as depicted in SEQ ID NO: 286. The conserved UDP-glucoronosyl/UDP-glucosyl transferase family domain is underlined and the UDP-glycosyltransferases signature is in bold.

FIG. 20: Amino acid sequence as depicted in SEQ ID NO: 287. The conserved UDP-glucoronosyl/UDP-glucosyl trans- FIG. 21: Amino acid sequence as depicted in SEQ ID NO: 288. The conserved UDP-glucoronosyl/UDP-glucosyl transferase family domain is underlined and the UDP-glycosyl-transferases signature is in bold.

FIG. 22: Amino acid sequence as depicted in SEQ ID NO: 289. The conserved UDP-glucoronosyl/UDP-glucosyl transferase family domain is underlined.

FIG. 23: Amino acid sequence as depicted in SEQ ID NO: 290. The conserved UDP-glucoronosyl/UDP-glucosyl transferase family domain is underlined and the UDP-glycosyl-transferases signature is in bold.

FIG. 24: Amino acid sequence as depicted in SEQ ID NO: 291. The conserved UDP-glucoronosyl/UDP-glucosyl transferase family domain is underlined and the UDP-glycosyl-transferases signature is in bold.

FIG. 25: Amino acid sequence as depicted in SEQ ID NO: 292. The conserved UDP-glucoronosyl/UDP-glucosyl transferase family domain is underlined and the UDP-glycosyl-transferases signature is in bold.

FIG. 26: Amino acid sequence as depicted in SEQ ID NO: 293. The conserved multicopper oxidase, type 1, family domain is underlined and the multicopper oxidases signature 2 is in bold.

FIG. 27: Amino acid sequence as depicted in SEQ ID NO: 294. The conserved multicopper oxidase, type 1, family domain is underlined, The multicopper oxidases signature 1 is in bold and the multicopper oxidases signature 2 is in bold/italics.

FIG. 28: Amino acid sequence as depicted in SEQ ID NO: 295. The conserved multicopper oxidase, type 1, family domains are underlined and the multicopper oxidase, copper-binding site is in bold.

FIG. 29: Amino acid sequence as depicted in SEQ ID NO: 296. The conserved multicopper oxidase, type 1, family domain is underlined and the multicopper oxidases signature 2 is in bold.

FIG. 30: Amino acid sequence as depicted in SEQ ID NO: 297. The conserved multicopper oxidase, type 1, family domain is underlined and the multicopper oxidases signature 2 is in bold.

FIG. 31: Amino acid sequence as depicted in SEQ ID NO: 298. The conserved multicopper oxidase, type 1, family domain is underlined, The multicopper oxidases signature 1 is in bold and the multicopper oxidases signature 2 is in bold/italics.

FIG. 32: Amino acid sequence as depicted in SEQ ID NO: 299. The conserved multicopper oxidase, type 1, family domain is underlined and the multicopper oxidases signature 2 is in bold.

FIG. 33: Amino acid sequence as depicted in SEQ ID NO: 300. The conserved multicopper oxidase, type 1, family domains are underlined and the multicopper oxidases signature 2 is in bold.

FIG. 34: Amino acid sequence as depicted in SEQ ID NO: 301. The conserved multicopper oxidase, type 1, family domain is underlined and the multicopper oxidases signature 2 is in bold.

FIG. 35: Amino acid sequence as depicted in SEQ ID NO: 302. The conserved multicopper oxidase, type 1, family domains are underlined and the multicopper oxidases signature 2 is in bold.

FIG. 36: Amino acid sequence as depicted in SEQ ID NO: 303. The conserved multicopper oxidase, type 1, family domain is underlined, The multicopper oxidases signature 1 is in bold and the multicopper oxidases signature 2 is in bold/italics.

FIG. 37: Amino acid sequence as depicted in SEQ ID NO: 304. The conserved multicopper oxidase, type 1, family domain is underlined, The multicopper oxidases signature 1 is in bold and the multicopper oxidases signature 2 is in bold/italics.

FIG. 38: Amino acid sequence as depicted in SEQ ID NO: 305. The conserved multicopper oxidase, type 1, family domains are underlined and the multicopper oxidases signature 2 is in bold.

FIG. 39: Amino acid sequence as depicted in SEQ ID NO: 306. The conserved cytochrome P450 family domain is underlined.

FIG. 40: Amino acid sequence as depicted in SEQ ID NO: 307. The conserved cytochrome P450 family domain is underlined.

FIG. 41: Amino acid sequence as depicted in SEQ ID NO: 308. The conserved cytochrome P450 family domain is underlined.

FIG. 42: Amino acid sequence as depicted in SEQ ID NO: 309. The conserved cytochrome P450 family domain is underlined and the cytochrome P450 cysteine heme-iron ligand signature is in bold.

FIG. 43: Amino acid sequence as depicted in SEQ ID NO: 310. The conserved cytochrome P450 family domain is underlined and the cytochrome P450 cysteine heme-iron ligand signature is in bold.

FIG. 44: Amino acid sequence as depicted in SEQ ID NO: 311. The conserved cytochrome P450 family domain is underlined and the cytochrome P450 cysteine heme-iron ligand signature is in bold.

FIG. 45: Amino acid sequence as depicted in SEQ ID NO: 312. The conserved cytochrome P450 family domain is underlined.

FIG. 46: Amino acid sequence as depicted in SEQ ID NO: 313. The conserved cytochrome P450 family domain is underlined.

FIG. 47: Amino acid sequence as depicted in SEQ ID NO: 314. The conserved cytochrome P450 family domain is underlined.

FIG. 48: Amino acid sequence as depicted in SEQ ID NO: 315. The conserved cytochrome P450 family domain is underlined.

FIG. 49: Amino acid sequence as depicted in SEQ ID NO: 316. The conserved cytochrome P450 family domain is underlined.

FIG. 50: Amino acid sequence as depicted in SEQ ID NO: 317. The conserved cytochrome P450 family domain is underlined.

FIG. 51: Amino acid sequence as depicted in SEQ ID NO: 318. The conserved O-methyltransferase domain of family 2 is underlined.

FIG. 52: Amino acid sequence as depicted in SEQ ID NO: 319. The conserved O-methyltransferase domain of family 2 is underlined.

FIG. 53: Amino acid sequence as depicted in SEQ ID NO: 320. The conserved O-methyltransferase domain of family 2 is underlined.

FIG. 54: Amino acid sequence as depicted in SEQ ID NO: 321. The conserved O-methyltransferase domain of family 2 is underlined.

FIG. 55: Amino acid sequence as depicted in SEQ ID NO: 322. The conserved O-methyltransferase domain of family 2 is underlined.

FIG. 56: Amino acid sequence as depicted in SEQ ID NO: 323. The conserved O-methyltransferase domain of family 2 is underlined.

FIG. 57: Amino acid sequence as depicted in SEQ ID NO: 324. The conserved O-methyltransferase domain of family 2 is underlined.

FIG. 58: Amino acid sequence as depicted in SEQ ID NO: 325. The conserved O-methyltransferase domain of family 2 is underlined.

FIG. 59: Amino acid sequence as depicted in SEQ ID NO: 326. The conserved O-methyltransferase domain of family 2 is underlined.

FIG. 60: Amino acid sequence as depicted in SEQ ID NO: 327. The conserved O-methyltransferase domain of family 2 is underlined.

FIG. 61: Amino acid sequence as depicted in SEQ ID NO: 328. The conserved O-methyltransferase domain of family 2 is underlined.

FIG. 62: Amino acid sequence as depicted in SEQ ID NO: 329. The conserved O-methyltransferase domain of family 2 is underlined.

FIG. 63: Amino acid sequence as depicted in SEQ ID NO: 331. The conserved O-methyltransferase domain of family 2 is underlined.

FIG. 64: Amino acid sequence as depicted in SEQ ID NO: 332. The conserved O-methyltransferase domain of family 2 is underlined.

FIG. 65: Amino acid sequence as depicted in SEQ ID NO: 333. The conserved O-methyltransferase domain of family 2 is underlined.

FIG. 66: Amino acid sequence as depicted in SEQ ID NO: 335. The conserved O-methyltransferase domain of family 2 is underlined.

FIG. 67: Amino acid sequence as depicted in SEQ ID NO: 336. The conserved O-methyltransferase domain of family 2 is underlined.

FIG. 68: Amino acid sequence as depicted in SEQ ID NO: 337. The conserved O-methyltransferase domain of family 2 is underlined.

FIG. 69: Amino acid sequence as depicted in SEQ ID NO: 339. The conserved O-methyltransferase domain of family 2 is underlined.

FIG. 70: Amino acid sequence as depicted in SEQ ID NO: 340. The conserved haem peroxidase family domain is underlined. The peroxidases active site signature and the peroxidases proximal heme-ligand signature are in bold.

FIG. 71: Amino acid sequence as depicted in SEQ ID NO: 341. The conserved haem peroxidase family domain is in bold. The peroxidases active site signature and the peroxidases proximal heme-ligand signature are in bold/italics. The plant ascorbate peroxidase domain is underlined.

FIG. 72: Amino acid sequence as depicted in SEQ ID NO: 342. The conserved haem peroxidase family domain is underlined. The peroxidases active site signature and the peroxidases proximal heme-ligand signature are in bold.

FIG. 73: Amino acid sequence as depicted in SEQ ID NO: 343. The conserved haem peroxidase family domain is underlined. The peroxidases active site signature and the peroxidases proximal heme-ligand signature are in bold.

FIG. 74: Amino acid sequence as depicted in SEQ ID NO: 344. The conserved haem peroxidase family domain is underlined and the peroxidases active site signature is in bold.

FIG. 75: Amino acid sequence as depicted in SEQ ID NO: 345. The conserved haem peroxidase family domain is underlined and the peroxidases proximal heme-ligand signature are in bold.

FIG. 76: Amino acid sequence as depicted in SEQ ID NO: 346. The conserved haem peroxidase family domain is underlined and the peroxidases proximal heme-ligand signature are in bold.

FIG. 77: Amino acid sequence as depicted in SEQ ID NO: 347. The conserved haem peroxidase family domain is underlined. The peroxidases active site signature and the peroxidases proximal heme-ligand signature are in bold.

FIG. 78: Amino acid sequence as depicted in SEQ ID NO: 348. The conserved haem peroxidase family domain is underlined and the peroxidases proximal heme-ligand signature is in bold.

FIG. 79: Amino acid sequence as depicted in SEQ ID NO: 349. The conserved haem peroxidase family domain is underlined. The peroxidases active site signature and the peroxidases proximal heme-ligand signature are in bold.

FIG. 80: Amino acid sequence as depicted in SEQ ID NO: 350. The conserved haem peroxidase family domain is underlined and the peroxidases active site signature is in bold.

FIG. 81: Amino acid sequence as depicted in SEQ ID NO: 351. The conserved haem peroxidase family domain is underlined. The peroxidases active site signature and the peroxidases proximal heme-ligand signature are in bold.

FIG. 82: Amino acid sequence as depicted in SEQ ID NO: 352. The conserved haem peroxidase family domain is underlined.

FIG. 83: Amino acid sequence as depicted in SEQ ID NO: 353. The conserved haem peroxidase family domain is underlined. The peroxidases active site signature and the peroxidases proximal heme-ligand signature are in bold.

FIG. 84: Amino acid sequence as depicted in SEQ ID NO: 354. The conserved haem peroxidase family domain is underlined. The peroxidases active site signature and the peroxidases proximal heme-ligand signature are in bold.

FIG. 85: Amino acid sequence as depicted in SEQ ID NO: 355. The conserved haem peroxidase family domain is underlined.

FIG. 86: Amino acid sequence as depicted in SEQ ID NO: 356. The conserved haem peroxidase family domain is underlined. The peroxidases active site signature and the peroxidases proximal heme-ligand signature are in bold.

FIG. 87: Amino acid sequence as depicted in SEQ ID NO: 357. The conserved haem peroxidase family domain is underlined and the peroxidases active site signature is in bold.

FIG. 88: Amino acid sequence as depicted in SEQ ID NO: 358. The conserved haem peroxidase family domain is underlined. The peroxidases active site signature and the peroxidases proximal heme-ligand signature are in bold.

FIG. 89: Amino acid sequence as depicted in SEQ ID NO: 359. The conserved haem peroxidase family domain is underlined.

FIG. 90: Amino acid sequence as depicted in SEQ ID NO: 360. The conserved haem peroxidase family domain is underlined. The peroxidases active site signature and the peroxidases proximal heme-ligand signature are in bold.

FIG. 91: Amino acid sequence as depicted in SEQ ID NO: 361. The conserved phenylalanine ammonia-lyase family domain is underlined. The phenylalanine/histidine ammonia-lyase family domain is in bold and the phenylalanine and histidine ammonia-lyases signature is in bold/italics.

FIG. 92: Amino acid sequence as depicted in SEQ ID NO: 362. The conserved phenylalanine/histidine ammonia-lyase family domain is underlined and the phenylalanine and histidine ammonia-lyases signature is in bold.

FIG. 93: Amino acid sequence as depicted in SEQ ID NO: 363. The conserved phenylalanine/histidine ammonia-lyase family domain is underlined and the phenylalanine and histidine ammonia-lyases signature is in bold.

FIG. 94: Amino acid sequence as depicted in SEQ ID NO: 364. The conserved phenylalanine/histidine ammonia-lyase family domain is underlined and the phenylalanine and histidine ammonia-lyases signature is in bold.

FIG. 95: Amino acid sequence as depicted in SEQ ID NO: 365. The conserved phenylalanine/histidine ammonia-lyase family domain is underlined and the phenylalanine and histidine ammonia-lyases signature is in bold.

FIG. 96: Amino acid sequence as depicted in SEQ ID NO: 366. The conserved phenylalanine/histidine ammonia-lyase family domain is underlined and the phenylalanine and histidine ammonia-lyases signature is in bold.

FIG. 97: Amino acid sequence as depicted in SEQ ID NO: 367. The conserved AMP dependent synthetase and ligase family domain is underlined and the AMP-binding domain signature is in bold.

FIG. 98: Amino acid sequence as depicted in SEQ ID NO: 378. The conserved glycoside hydrolase, family 1, domain is underlined and the glycosyl hydrolases family 1 N-terminal signature is in bold.

FIG. 99: Amino acid sequence as depicted in SEQ ID NO: 379. The conserved glycoside hydrolase, family 1, domain is underlined.

FIG. 100: Amino acid sequence as depicted in SEQ ID NO: 380. The conserved glycoside hydrolase, family 1, domain is underlined.

FIG. 101: Amino acid sequence as depicted in SEQ ID NO: 381. The conserved glycoside hydrolase, family 1, domain is underlined.

FIG. 102: Amino acid sequence as depicted in SEQ ID NO: 382. The conserved glycoside hydrolase, family 1, domain is underlined and the glycosyl hydrolases family 1 N-terminal signature is in bold.

FIG. 103: Amino acid sequence as depicted in SEQ ID NO: 383. The conserved glycoside hydrolase family 1 domain is underlined, and the glycosyl hydrolase family 1 N-terminal signature is in bold FIG. 104: Amino acid sequence as depicted in SEQ ID NO: 384. The conserved glycoside hydrolase, family 1, domain is underlined and the glycosyl hydrolases family 1 N-terminal signature is in bold.

FIG. 105: Amino acid sequence as depicted in SEQ ID NO: 385. The conserved glycoside hydrolase, family 1, domain is underlined and the glycosyl hydrolases family 1 N-terminal signature is in bold.

FIG. 106: Amino acid sequence as depicted in SEQ ID NO: 386. The conserved glycoside hydrolase, family 1, domain is underlined and the glycosyl hydrolases family 1 N-terminal signature is in bold.

FIG. 107: Amino acid sequence as depicted in SEQ ID NO: 387. The conserved glycoside hydrolase, family 1, domain is underlined. The glycosyl hydrolases family 1 N-terminal signature and glycosyl hydrolases family 1 active site is in bold.

FIG. 108: Amino acid sequence as depicted in SEQ ID NO: 388. The conserved glycoside hydrolase, family 1, domain is underlined.

FIG. 109: Amino acid sequence as depicted in SEQ ID NO: 389. The conserved glycoside hydrolase, family 1, domain is underlined.

FIG. 110: Amino acid sequence as depicted in SEQ ID NO: 390. The conserved zinc-containing alcohol dehydrogenase superfamily domain is underlined and the zinc-containing alcohol dehydrogenases signature is in bold.

FIG. 111: Amino acid sequence as depicted in SEQ ID NO: 391. The conserved zinc-containing alcohol dehydrogenase superfamily domain is underlined and the zinc-containing alcohol dehydrogenases signature is in bold.

FIG. 112: Amino acid sequence as depicted in SEQ ID NO: 392. The conserved zinc-containing alcohol dehydrogenase superfamily domain is underlined and the zinc-containing alcohol dehydrogenases signature is in bold.

FIG. 113: Amino acid sequence as depicted in SEQ ID NO: 393. The conserved zinc-containing alcohol dehydrogenase superfamily domain is underlined and the zinc-containing alcohol dehydrogenases signature is in bold.

FIG. 114: Amino acid sequence as depicted in SEQ ID NO: 394. The conserved zinc-containing alcohol dehydrogenase superfamily domain is underlined and the zinc-containing alcohol dehydrogenases signature is in bold.

FIG. 115: Amino acid sequence as depicted in SEQ ID NO: 395. The conserved zinc-containing alcohol dehydrogenase superfamily domain is underlined and the zinc-containing alcohol dehydrogenases signature is in bold.

FIG. 116: Amino acid sequence as depicted in SEQ ID NO: 396. The conserved zinc-containing alcohol dehydrogenase superfamily domain is underlined and the zinc-containing alcohol dehydrogenases signature is in bold.

FIG. 117: Amino acid sequence as depicted in SEQ ID NO: 397. The conserved zinc-containing alcohol dehydrogenase superfamily domain is underlined. The zinc-containing alcohol dehydrogenases signature is in bold and the D-isomer specific 2-hydroxyacid dehydrogenases NAD-binding signature is in italics.

FIG. 118: Amino acid sequence as depicted in SEQ ID NO: 398. The conserved zinc-containing alcohol dehydrogenase superfamily domain is underlined and the zinc-containing alcohol dehydrogenases signature is in bold.

FIG. 119: Amino acid sequence as depicted in SEQ ID NO: 399. The conserved zinc-containing alcohol dehydrogenase superfamily domain is underlined and the zinc-containing alcohol dehydrogenases signature is in bold.

FIG. 120: Amino acid sequence as depicted in SEQ ID NO: 400. The conserved zinc-containing alcohol dehydrogenase superfamily domain is underlined and the zinc-containing alcohol dehydrogenases signature is in bold.

FIG. 121: Amino acid sequence as depicted in SEQ ID NO: 401. The conserved zinc-containing alcohol dehydrogenase superfamily domain is underlined and the zinc-containing alcohol dehydrogenases signature is in bold.

FIG. 122: Amino acid sequence as depicted in SEQ ID NO: 402. The conserved zinc-containing alcohol dehydrogenase superfamily domain is underlined.

FIG. 123: Amino acid sequence as depicted in SEQ ID NO: 403. The conserved zinc-containing alcohol dehydrogenase superfamily domain is underlined.

FIG. 124: Amino acid sequence as depicted in SEQ ID NO: 404. The conserved UDP-glucoronosyl/UDP-glucosyl transferase family domain is underlined and the UDP-glycosyltransferases signature is in bold.

FIG. 125: Amino acid sequence as depicted in SEQ ID NO: 405. The conserved UDP-glucoronosyl/UDP-glucosyl transferase family domain is underlined and the UDP-glycosyltransferases signature is in bold.

FIG. 126: Amino acid sequence as depicted in SEQ ID NO: 406. The conserved UDP-glucoronosyl/UDP-glucosyl transferase family domain is underlined and the UDP-glycosyltransferases signature is in bold.

FIG. 127: Amino acid sequence as depicted in SEQ ID NO: 407. The conserved UDP-glucoronosyl/UDP-glucosyl transferase family domain is underlined and the UDP-glycosyltransferases signature is in bold.

FIG. 128: Amino acid sequence as depicted in SEQ ID NO: 408. The conserved UDP-glucoronosyl/UDP-glucosyl transferase family domain is underlined and the UDP-glycosyltransferases signature is in bold.

FIG. 129: Amino acid sequence as depicted in SEQ ID NO: 409. The conserved UDP-glucoronosyl/UDP-glucosyl transferase family domain is underlined and the UDP-glycosyltransferases signature is in bold.

FIG. 130: Amino acid sequence as depicted in SEQ ID NO: 410. The conserved UDP-glucoronosyl/UDP-glucosyl transferase family domain is underlined FIG. 131: Amino acid sequence as depicted in SEQ ID NO: 411. The conserved UDP-glucoronosyl/UDP-glucosyl transferase family domain is underlined and the UDP-glycosyltransferases signature is in bold.

FIG. 132: Amino acid sequence as depicted in SEQ ID NO: 412. The conserved UDP-glucoronosyl/UDP-glucosyl transferase family domain is underlined.

FIG. 133: Amino acid sequence as depicted in SEQ ID NO: 413. The conserved multicopper oxidase, type 1, family domain is underlined and the multicopper oxidases signature 2 is in bold.

FIG. 134: Amino acid sequence as depicted in SEQ ID NO: 414. The conserved multicopper oxidase, type 1, family domain is underlined and the multicopper oxidases signature 2 is in bold.

FIG. 135: Amino acid sequence as depicted in SEQ ID NO: 415. The conserved multicopper oxidase, type 1, family domain is underlined and the multicopper oxidases signature 2 is in bold.

FIG. 136: Amino acid sequence as depicted in SEQ ID NO: 416. The conserved multicopper oxidase, type 1, family domain is underlined and the multicopper oxidases signature 2 is in bold.

FIG. 137: Amino acid sequence as depicted in SEQ ID NO: 417. The conserved multicopper oxidase, type 1, family domain is underlined and the conserved domains are in bold FIG. 138: Amino acid sequence as depicted in SEQ ID NO: 418. The conserved multicopper oxidase, type 1, family domain is underlined and the conserved domains are in bold FIG. 139: Amino acid sequence as depicted in SEQ ID NO: 419. The conserved multicopper oxidase, type 1, family domain is underlined and the multicopper oxidases signature 2 is in bold.

FIG. 140: Amino acid sequence as depicted in SEQ ID NO: 420. The conserved multicopper oxidase, type 1, family domain is underlined and the multicopper oxidases signature 2 is in bold.

FIG. 141: Amino acid sequence as depicted in SEQ ID NO: 421. The conserved multicopper oxidase, type 1, family domain is underlined and the conserved domains are in bold FIG. 142: Amino acid sequence as depicted in SEQ ID NO: 422. The conserved multicopper oxidase, type 1, family domains are underlined FIG. 143: Amino acid sequence as depicted in SEQ ID NO: 423. The conserved multicopper oxidase, type 1, family domain is underlined and the conserved domains are in bold FIG. 144: Amino acid sequence as depicted in SEQ ID NO: 424. The conserved multicopper oxidase, type 1, family domains are underlined and the multicopper oxidases signature 2 is in bold.

FIG. 145: Amino acid sequence as depicted in SEQ ID NO: 425. The conserved multicopper oxidase, type 1, family domains are underlined.

FIG. 146: Amino acid sequence as depicted in SEQ ID NO: 426. The conserved multicopper oxidase, type 1, family domains are underlined, The multicopper oxidases signature 1 is in bold and the multicopper oxidases signature 2 is in bold/italics.

FIG. 147: Amino acid sequence as depicted in SEQ ID NO: 427. The conserved multicopper oxidase, type 1, family domain is underlined.

FIG. 148: Amino acid sequence as depicted in SEQ ID NO: 428. The conserved multicopper oxidase, type 1, family domains are underlined and the multicopper oxidases signature 2 is in bold.

FIG. 149: Amino acid sequence as depicted in SEQ ID NO: 429. The conserved multicopper oxidase, type 1, family domains are underlined and the multicopper oxidases signature 2 is in bold.

FIG. 150: Amino acid sequence as depicted in SEQ ID NO: 430. The conserved cytochrome P450 family domain is underlined.

FIG. 151: Amino acid sequence as depicted in SEQ ID NO: 431. The conserved cytochrome P450 family domain is underlined.

FIG. 152: Amino acid sequence as depicted in SEQ ID NO: 432. The conserved cytochrome P450 family domain is underlined and the E-class P450, group I domain is in bold.

FIG. 153: Amino acid sequence as depicted in SEQ ID NO: 433. The conserved cytochrome P450 family domain is underlined FIG. 154: Amino acid sequence as depicted in SEQ ID NO: 434. The conserved cytochrome P450 family domain is underlined FIG. 155: Amino acid sequence as depicted in SEQ ID NO: 435. The conserved cytochrome P450 family domain is underlined FIG. 156: Amino acid sequence as depicted in SEQ ID NO: 436. The conserved cytochrome P450 family domain is underlined FIG. 157: Amino acid sequence as depicted in SEQ ID NO: 437. The conserved cytochrome P450 family domain is underlined.

FIG. 158: Amino acid sequence as depicted in SEQ ID NO: 438. The conserved cytochrome P450 family domain is underlined FIG. 159: Amino acid sequence as depicted in SEQ ID NO: 439. The conserved cytochrome P450 family domain is underlined and the E-class P450, group I domains are in bold.

FIG. 160: Amino acid sequence as depicted in SEQ ID NO: 440. The conserved cytochrome P450 family domain is underlined.

FIG. 161: Amino acid sequence as depicted in SEQ ID NO: 441. The conserved cytochrome P450 family domain is underlined.

FIG. 162: Amino acid sequence as depicted in SEQ ID NO: 442. The conserved cytochrome P450 family domain is underlined.

FIG. 163: Amino acid sequence as depicted in SEQ ID NO: 443. The conserved cytochrome P450 family domain is underlined.

FIG. 164: Amino acid sequence as depicted in SEQ ID NO: 444. The conserved cytochrome P450 family domain is underlined.

FIG. 165: Amino acid sequence as depicted in SEQ ID NO: 445. The conserved O-methyltransferase domain of family 2 is underlined.

FIG. 166: Amino acid sequence as depicted in SEQ ID NO: 446. The conserved O-methyltransferase domain of family 2 is underlined.

FIG. 167: Amino acid sequence as depicted in SEQ ID NO: 447. The conserved O-methyltransferase domain of family 2 is underlined.

FIG. 168: Amino acid sequence as depicted in SEQ ID NO: 448. The conserved O-methyltransferase domain of family 2 is underlined FIG. 169: Amino acid sequence as depicted in SEQ ID NO: 449. The conserved O-methyltransferase domain of family 2 is underlined FIG. 170: Amino acid sequence as depicted in SEQ ID NO: 450. The conserved O-methyltransferase domain of family 2 is underlined FIG. 171: Amino acid sequence as depicted in SEQ ID NO: 451. The conserved O-methyltransferase domain of family 2 is underlined FIG. 172: Amino acid sequence as depicted in SEQ ID NO: 452. The conserved O-methyltransferase domain of family 2 is underlined FIG. 173: Amino acid sequence as depicted in SEQ ID NO: 453. The conserved O-methyltransferase domain of family 2 is underlined.

FIG. 174: Amino acid sequence as depicted in SEQ ID NO: 454. The conserved O-methyltransferase domain of family 2 is underlined.

FIG. 175: Amino acid sequence as depicted in SEQ ID NO: 455. The conserved O-methyltransferase domain of family 2 is underlined.

FIG. 176: Amino acid sequence as depicted in SEQ ID NO: 456. The conserved O-methyltransferase domain of family 2 is underlined.

FIG. 177: Amino acid sequence as depicted in SEQ ID NO: 457. The conserved O-methyltransferase domain of family 2 is underlined.

FIG. 178: Amino acid sequence as depicted in SEQ ID NO: 458. The conserved O-methyltransferase domain of family 2 is underlined.

FIG. 179: Amino acid sequence as depicted in SEQ ID NO: 459. The conserved O-methyltransferase domain of family 2 is underlined.

FIG. 180: Amino acid sequence as depicted in SEQ ID NO: 460. The conserved O-methyltransferase domain of family 2 is underlined FIG. 181: Amino acid sequence as depicted in SEQ ID NO: 461. The conserved O-methyltransferase domain of family 2 is underlined FIG. 182: Amino acid sequence as depicted in SEQ ID NO: 462. The conserved O-methyltransferase domain of family 2 is underlined.

FIG. 183: Amino acid sequence as depicted in SEQ ID NO: 463. The conserved O-methyltransferase domain of family 2 is underlined FIG. 184: Amino acid sequence as depicted in SEQ ID NO: 464. The conserved O-methyltransferase domain of family 2 is underlined FIG. 185: Amino acid sequence as depicted in SEQ ID NO: 465. The conserved O-methyltransferase domain of family 2 is underlined.

FIG. 186: Amino acid sequence as depicted in SEQ ID NO: 466. The conserved O-methyltransferase, family 2 domain is underlined FIG. 187: Amino acid sequence as depicted in SEQ ID NO: 467. The conserved O-methyltransferase, family 2 domain is underlined FIG. 188: Amino acid sequence as depicted in SEQ ID NO: 468. The conserved O-methyltransferase domain of family 2 is underlined.

FIG. 189: Amino acid sequence as depicted in SEQ ID NO: 469. The conserved O-methyltransferase domain of family 2 is underlined.

FIG. 190: Amino acid sequence as depicted in SEQ ID NO: 470. The conserved O-methyltransferase domain of family 2 is underlined.

FIG. 191: Amino acid sequence as depicted in SEQ ID NO: 471. The conserved O-methyltransferase domain of family 2 is underlined.

FIG. 192: Amino acid sequence as depicted in SEQ ID NO: 472. The conserved O-methyltransferase domain of family 2 is underlined.

FIG. 193: Amino acid sequence as depicted in SEQ ID NO: 473. The conserved O-methyltransferase domain of family 2 is underlined.

FIG. 194: Amino acid sequence as depicted in SEQ ID NO: 474. The conserved O-methyltransferase domain of family 2 is underlined.

FIG. 195: Amino acid sequence as depicted in SEQ ID NO: 475. The conserved O-methyltransferase domain of family 2 is underlined.

FIG. 196: Amino acid sequence as depicted in SEQ ID NO: 476. The conserved O-methyltransferase domain of family 2 is underlined.

FIG. 197: Amino acid sequence as depicted in SEQ ID NO: 477. The conserved O-methyltransferase domain of family 2 is underlined.

FIG. 198: Amino acid sequence as depicted in SEQ ID NO: 478. The conserved O-methyltransferase domain of family 2 is underlined.

FIG. 199: Amino acid sequence as depicted in SEQ ID NO: 479. The conserved O-methyltransferase domain of family 3 is underlined.

FIG. 200: Amino acid sequence as depicted in SEQ ID NO: 480. The conserved haem peroxidase family domain is underlined and the peroxidases active site signature is in bold.

FIG. 201: Amino acid sequence as depicted in SEQ ID NO: 481. The conserved haem peroxidase family domain is underlined and the peroxidases active site signature is in bold.

FIG. 202: Amino acid sequence as depicted in SEQ ID NO: 482. The conserved haem peroxidase family domain is in underlined. The peroxidases active site signature and the peroxidases proximal heme-ligand signature are in bold.

FIG. 203: Amino acid sequence as depicted in SEQ ID NO: 483. The conserved haem peroxidase family domain is in underlined. The peroxidases active site signature and the peroxidases proximal heme-ligand signature are in bold.

FIG. 204: Amino acid sequence as depicted in SEQ ID NO: 484. The conserved haem peroxidase family domain is underlined and the peroxidases proximal heme-ligand signature is in bold.

FIG. 205: Amino acid sequence as depicted in SEQ ID NO: 485. The conserved haem peroxidase family domain is underlined. The peroxidases active site signature and the peroxidases proximal heme-ligand signature are in bold.

FIG. 206: Amino acid sequence as depicted in SEQ ID NO: 486. The conserved haem peroxidase family domain is underlined. The peroxidases active site signature and the peroxidases proximal heme-ligand signature are in bold.

FIG. 207: Amino acid sequence as depicted in SEQ ID NO: 487. The conserved haem peroxidase family domain is underlined. The peroxidases active site signature and the peroxidases proximal heme-ligand signature are in bold.

FIG. 208: Amino acid sequence as depicted in SEQ ID NO: 488. The conserved haem peroxidase family domain is underlined. The peroxidases active site signature and the peroxidases proximal heme-ligand signature are in bold.

FIG. 209: Amino acid sequence as depicted in SEQ ID NO: 489. The conserved haem peroxidase family domain is underlined FIG. 210: Amino acid sequence as depicted in SEQ ID NO: 490. The conserved haem peroxidase family domain is underlined FIG. 211: Amino acid sequence as depicted in SEQ ID NO: 491. The conserved haem peroxidase family domain is underlined FIG. 212: Amino acid sequence as depicted in SEQ ID NO: 492. The conserved haem peroxidase family domain is underlined FIG. 213: Amino acid sequence as depicted in SEQ ID NO: 493. The conserved haem peroxidase family domain is underlined FIG. 214: Amino acid sequence as depicted in SEQ ID NO: 494. The conserved haem peroxidase family domain is underlined FIG. 215: Amino acid sequence as depicted in SEQ ID NO: 495. The conserved haem peroxidase family domain is underlined and the peroxidases proximal heme-ligand signature is in bold.

FIG. 216: Amino acid sequence as depicted in SEQ ID NO: 496. The conserved haem peroxidase family domain is underlined. The peroxidases proximal heme-ligand signature and the peroxidases active site signature are in bold.

FIG. 217: Amino acid sequence as depicted in SEQ ID NO: 497. The conserved haem peroxidase family domain is underlined.

FIG. 218: Amino acid sequence as depicted in SEQ ID NO: 498. The conserved haem peroxidase family domain is underlined.

FIG. 219: Amino acid sequence as depicted in SEQ ID NO: 499. The conserved phenylalanine/histidine ammonia-lyase family domain is underlined and the phenylalanine and histidine ammonia-lyases signature is in bold.

FIG. 220: Amino acid sequence as depicted in SEQ ID NO: 500. The conserved phenylalanine/histidine ammonia-lyase family domain is underlined and the phenylalanine and histidine ammonia-lyases signature is in bold.

FIG. 221: Amino acid sequence as depicted in SEQ ID NO: 501. The conserved phenylalanine/histidine ammonia-lyase family domain is underlined and the phenylalanine and histidine ammonia-lyases signature is in bold.

FIG. 222: Amino acid sequence as depicted in SEQ ID NO: 502. The conserved phenylalanine/histidine ammonia-lyase family domain is underlined and the phenylalanine and histidine ammonia-lyases signature is in bold.

FIG. 223: Amino acid sequence as depicted in SEQ ID NO: 503. The conserved Phenylalanine/histidine ammonia-lyase domain is underlined FIG. 224: Amino acid sequence as depicted in SEQ ID NO: 504. The conserved Phenylalanine/histidine ammonia-lyase domain is underlined FIG. 225: Amino acid sequence as depicted in SEQ ID NO: 766. The conserved AMP dependent synthetase and ligase family domain is underlined and the AMP-binding domain signature is in bold.

FIG. 226: Amino acid sequence as depicted in SEQ ID NO: 769. The conserved multicopper oxidase, type 1, family domain is underlined and the conserved domains are in bold.

FIG. 227: HPLC analysis of sinapoyl malate in *Eucalyptus* Cald5H transgenic fah1 plants transformed with SEQ ID NOs: 784.

FIG. 228: HPLC analysis of sinapoyl malate in *Eucalyptus* Cald5H transgenic fah1 plants transformed with SEQ ID NOs: 785.

FIG. 229: Fukushima and Hatfield determinations of lignin content in pARB373-, pARB460-, and control construct-transformed *E. grandis* plants.

FIG. 230: The average heights and lignin content of pARB373- (SEQ ID NO: 763), pARB460- (SEQ ID NO: 762), and control construct-transformed plants.

FIG. 231: DFRC analysis of samples from pARB373- (SEQ ID NO: 763), pARB460- (SEQ ID NO: 762), and control construct-transformed plants.

FIG. 232: Maule staining results for syringyl transformed *P. taeda* and controls.

FIG. 233: The analysis of plant lignin composition by pyrolysis molecular beam mass spectrometry.

DETAILED DESCRIPTION

The invention provides novel isolated lignin synthesis, transport and polymerization genes and polynucleotides useful for altering the phenotypic properties of plants. The invention also provides methods for identifying multigenic factors that contribute to a phenotype and for manipulating gene expression to affect plant phenotype. These genes were derived from plants of commercially important forestry genera, pine and eucalyptus. These genes are involved in each stage of the lignificiation process—monolignol synthesis, monolignol transport, and the final polymerization of lignin—and are, at least in part, responsible for the expression of phenotypic characteristics important in the commercial industry, including, but not limited to, cellulose and lignin content, coarseness, density, extratives content, fiber dimensions, stiffness, and strength. Generally, the genes and polynucleotides encode proteins which can be cinnamate-4-hydroxylase, cinnamoyl-CoA reductase, cinnamoyl alcohol dehydrogenase, 4-coumarate-CoA ligase, coumarate 3-hydroxylase, coniferin beta-glucosidase, coniferyl alcohol dehydrogenase, coniferyl aldehyde 5-hydrolase, cytocrome p450, dihydroflavonol 4-reductase, multicopper oxidase, o-methyltransferase, peroxidase, phenolase, phenylalanine ammonia lyase, sinapyl alcohol dehydrogenase, SPI2 protein, and UDP-glucosyltransferase.

The methods of the present invention for selecting and using lignin synthesis, transportation, and polymerization genes for modulation of lignin synthesis provide transgenic plants with more highly engineered phenotypes. The ability to control plant architecture and agronomically important traits in plants is improved.

Unless indicated otherwise, all technical and scientific terms are used herein in a manner that conforms to common technical usage. Generally, the nomenclature of this description and the described laboratory procedures, including cell culture, molecular genetics, and nucleic acid chemistry and hybridization, respectively, are well known and commonly employed in the art. Standard techniques are used for recombinant nucleic acid methods, oligonucleotide synthesis, cell culture, tissue culture, transformation, transfection, transduction, analytical chemistry, organic synthetic chemistry, chemical syntheses, chemical analysis, and pharmaceutical formulation and delivery. Generally, enzymatic reactions and purification and/or isolation steps are performed according to the manufacturers' specifications. Absent an indication to the contrary, the techniques and procedures in question are performed according to conventional methodology disclosed, for example, in Sambrook J. and D. W. Russell (2001) MOLECULAR CLONING A LABORATORY MANUAL, 3d ed., Cold Spring Harbor Laboratory Press, Cold Spring Harbor, N.Y., and Ausubel et al. (1989) CURRENT PROTOCOLS IN MOLECULAR BIOLOGY, John Wiley & Sons, Brooklyn, N.Y. Specific scientific methods relevant to the present invention are discussed in more detail below. However, this discussion is provided as an example only, and does not limit the manner in which the methods of the invention can be carried out.

I. Monolignol Synthesis, Monolignol Transport, and Lignin Polymerization Genes, Polynucleotide and Polypeptide Sequences One aspect of the present invention relates to novel monolignol synthesis, monolignol transport, and lignin polymerization genes and polypeptides encoded by such genes.

The present invention provides novel plant monolignol synthesis, monolignol transport, and lignin polymerization genes and polynucleotides and novel monolignol synthesis, monolignol transport, and lignin polymerization proteins and polypeptides. In one embodiment, the novel monolignol synthesis, monolignol transport, and lignin polymerization genes are the same as those expressed in a wild-type plant of a species of *Pinus* or *Eucalyptus*. As used herein, "wild-type" refers generally to a phenotype, genotype, or gene in a population or stain of organisms in contrast to that of organisms transformed by laboratory techniques. Specific exemplary novel plant monolignol synthesis, monolignol transport, and lignin polymerization gene sequences of the invention are set forth in TABLE 1, TABLE 2, TABLE 3, and TABLE 4, which comprise *Pinus radiata* gene sequences, corresponding protein sequences encoded by those genes, and related oligonucleotide sequences, and TABLE 5, TABLE 6, TABLE 7, and TABLE 8, which comprise *Eucalyptus grandis* gene sequences, corresponding protein sequences encoded by those genes, and related oligonucleotide sequences.

The sequences of the invention have monolignol synthesis, monolignol transport, and/or lignin polymerization activity and encode proteins that are active in monolignol synthesis, such as proteins of the cinnamic acid and sinapyl alcohol enzymatic pathways, monolignol transport, such as caffeate O-methyltransferase, caffeoyl-CoA O-methyltransferase, cinnamoyl-CoA reductase, trans-cinnamate 4-monooxygenase, coniferyl-alcohol glucosyltransferase, coniferin beta-glucosidase, coniferyl alcohol dehydrogenase, para-coumarate 3-monooxygenase, 4-coumarate CoA ligase, ferrulate 5-monooxygenase, laccase, mannitol dehydrogenase, peroxidase, and phenylalanine ammonia-lyase. As discussed below, manipulation of the expression of the monolignol synthesis, monolignol transport, and lignin polymerization genes and polynucleotides, or manipulation of the activity of the encoded proteins and polypeptides, can resulting a transgenic plant with a desired phenotype that differs from the phenotype of a wild-type plant of the same species.

The present invention also includes sequences that are complements, reverse sequences or reverse compliments to the nucleotide sequences disclosed herein.

Throughout this description, reference is made to monolignol synthesis, monolignol transport, and lignin polymerization genes products. As used herein, a "monolignol synthesis, monolignol transport, or lignin polymerization gene product" is a product encoded by a monolignol synthesis, monolignol transport, or lignin polymerization gene, including both nucleotide products, such as DNA and RNA, and amino acid products, such as proteins and polypeptides. Monolignol synthesis, monolignol transport, or lignin polymerization gene products possess enzamatic or catalytic activities useful in the biosynthesis of monolignols, the transport of monolingols, or the polymerization of lignin. Exemplary monolignol synthesis, monolignol transport, or lignin polymerization gene products include, but are not limited to, caffeate O-methyltransferase, caffeoyl-CoA O-methyltransferase, cinnamoyl-CoA reductase, trans-cinnamate 4-monooxygenase, coniferyl-alcohol glucosyltransferase, coniferin beta-glucosidase, coniferyl alcohol dehydrogenase, para-coumarate 3-monooxygenase, 4-coumarate CoA ligase, ferrulate 5-monooxygenase, laccase, mannitol dehydrogenase, peroxidase, and phenylalanine ammonia-lyase. Moreover, gene products possessing O-methyltransferase activity may possesses a specific substrated activity including, but not limited to, 5-hydroxyconiferyl aldehyde O-methyltransferase (AldOMT), caffeic acid O-methyltransferase, caffeoyl-CoA O-methyltransferase, catechol-CoA O-methyltransferase, and inositol O-methyltransferase. Likewise, gene products possessing peroxidase activity may possesses a specific substrated activity including, but not limited to, anionic peroxidase, ascorbate peroxidase, and cationic peroxidase.

Examples of specific monolignol synthesis, monolignol transport, and lignin polymerization genes include SEQ ID NOs: 1-252, 756 and 768. Examples of specific monolignol synthesis, monolignol transport, and lignin polymerization gene products of the invention include products encoded by any one of SEQ ID NOs: 1-252, 756 and 768. Examples of specific monolignol synthesis, monolignol transport, and lignin polymerization proteins and polypeptides of the invention include polypeptides encoded by any of SEQ ID NOs: 253-504, 766 and 769 or polypeptides comprising the amino acid sequence of any of SEQ ID NOs: 1-252, 756 and 768. Another aspect of the invention is directed to conservative variants, as defined below, of these specific monolignol synthesis, monolignol transport, and lignin polymerization genes and their nucleotide and amino acid products.

The present invention also includes conservative variants of the sequences disclosed herein. The term "variant" refers to a nucleotide or amino acid sequence that differs in one or more nucleotide bases or amino acid residues from the reference sequence of which it is a variant.

Accordingly, in one respect, the invention includes conservative variant polynucleotides. As used herein, the term "conservative variant polynucleotide" refers to a polynucleotide that hybridizes under stringent conditions to an oligonucleotide probe that, under comparable conditions, binds to the reference gene the conservative variant is a variant of. Thus, for example, a conservative variant of SEQ ID NO: 1 hybridizes under stringent conditions to an oligonucleotide probe that, under comparable conditions, binds to SEQ ID NO: 1. For example, sequences are considered to hybridize when they form a double-stranded complex in a hybridization solution of 6×SSC, 0.5% SDS, 5×Denhardt's solution and 100 µg of non-specific carrier DNA. See Ausubel et al., section 2.9, supplement 27 (1994). "Moderate stringency" is defined as a temperature of 60° C. in a hybridization solution of 6×SSC, 0.5% SDS, 5×Denhardt's solution and 100 µg of non-specific carrier DNA. Id. "High stringency" hybridization conditions are, for example, 68° C. in a hybridization solution of 6×SSC, 0.5% SDS, 5×Denhardt's solution and 100 µg of non-specific carrier DNA. Following the moderate stringency hybridization reaction, the nucleotides are washed in a solution of 2×SSC plus 0.05% SDS for five times at room temperature, with subsequent washes with 0.1×SSC plus 0.1% SDS at 60° C. for 1 h.

One aspect of the invention provides conservative variant polynucleotides that exhibit at least about 75% sequence identity to their respective reference sequences. "Sequence identity" has an art-recognized meaning and can be calculated using published techniques. See COMPUTATIONAL MOLECULAR BIOLOGY, Lesk, ed. (Oxford University Press, 1988), BIOCOMPUTING: INFORMATICS AND GENOME PROJECTS, Smith, ed. (Academic Press, 1993), COMPUTER ANALYSIS OF SEQUENCE DATA, PART I, Griffin & Griffin, eds., (Humana Press, 1994), SEQUENCE ANALYSIS IN MOLECULAR BIOLOGY, Von Heinje ed., Academic Press (1987), SEQUENCE ANALYSIS PRIMER, Gribskov & Devereux, eds. (Macmillan Stockton Press, 1991), Gish et al., *J. Mol. Biol.* 215: 403 (1990); Gish and States, *Nature Genet.* 3: 266 (1993); Madden et al., *Meth. Enzymol.* 266:131 (1996); Altschul et al., *Nucleic Acids Res.* 25: 3389 (1997); and Zhang and Madden, *Genome Res.* 7: 649-656 (1997), and Carillo and Lipton, SIAM *J. Applied Math.* 48: 1073 (1988). Methods commonly employed to determine identity or similarity between two sequences include but are not limited to those disclosed in GUIDE TO HUGE COMPUTERS, Bishop, ed., (Academic Press, 1994) and Carillo & Lipton, supra.

Methods to determine identity and similarity are codified in and executed by, for example, computer programs and algorithms. Preferred computer program methods to determine identity and similarity between two sequences include but are not limited to the GCG program package (Devereux et al., *Nucleic Acids Research* 12: 387 (1984)), BLASTP, BLASTN, FASTA (Atschul et al., *J. Mol. Biol.* 215: 403 (1990)), and FASTDB (Brutlag et al., *Comp. App. Biosci.* 6: 237 (1990)).

The invention includes conservative variant polynucleotides having a sequence identity that is greater than or equal to 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, 75%, 74%, 73%, 72%, 71%, 70%, 69%, 68%, 67%, 66%, 65%, 64%, 63%, 62%, 61%, or 60% to any one of SEQ ID NO: 1-252, 756 and 768. In such variants, differences between the variant and the reference sequence can occur at the 5' or 3' terminal positions of the reference nucleotide sequence or anywhere between those terminal positions, interspersed either individually among nucleotides in the reference sequence or in one or more contiguous groups within the reference sequence.

Additional conservative variant polynucleotides contemplated by and encompassed within the present invention include polynucleotides comprising sequences that differ from the polynucleotide sequences of SEQ ID NOs: 1-252, 756 and 768 or complements, reverse complements or reverse sequences thereof, as a result of deletions and/or insertions totaling less than 30% of the total sequence length. In one embodiment, deletions and/or insertions total less than 20% or less than 10% of the total length.

The invention also includes conservative variant polynucleotides that, in addition to sharing a high degree of similarity in their primary structure (sequence) to SEQ ID NOs have at least one of the following features: (i) they contain an open reading frame or partial open reading frame encoding a polypeptide having substantially the same functional properties in polynucleotide synthesis as the polypeptide encoded by the reference polynucleotide, or (ii) they have nucleotide domains or encoded protein domains in common. The invention includes conservative variants of SEQ ID NOs: 1-252, 756 and 768 that encode proteins having the enzyme or biological activity or binding properties of the protein encoded by the reference polynucleotide. Such conservative variants are functional variants, in that they have the enzymatic or binding activity of the protein encoded by the reference polynucleotide.

In accordance with one embodiment, polynucleotide variants can include a "shuffled gene" such as those described in e.g. U.S. Pat. Nos. 6,500,639, 6,500,617, 6,436,675, 6,379,964, 6,352,859 6,335,198 6,326,204, and 6,287,862. A variant of a nucleotide sequence of the present invention also can be a polynucleotide modified as disclosed in U.S. Pat. No. 6,132,970, which is incorporated herein by reference.

In accordance with one embodiment, the invention provides a polynucleotide that encodes a monolignol synthesis, monolignol transport, and lignin polymerization protein such as beta-glucosidase, beta-mannasidase, cinnamate-4-hydroxylase, cinnamoyl-CoA reductase, cinnamoyl alcohol dehydrogenase, 4-coumarate-CoA ligase, coumarate 3-hydroxylase, coniferyl alcohol dehydrogenase, coniferyl aldehyde 5-hydrolase, cytocrome p450, dihydroflavonol 4-reductase, diphenol oxidase, multicopper oxidase, O-methyltransferase, peroxidase, phenolase, phenylalanine ammonia lyase, sinapyl alcohol dehydrogenase, SPI2 protein, and UDP-glucosyltransferase. Moreover, the O-methyltransferase protein may be any of 5-hydroxyconiferyl aldehyde O-methyltransferase (AldOMT), caffeic acid O-methyltransferase, caffeoyl-CoA O-methyltransferase, catechol-CoA O-methyltransferase, or inositol O-methyltransferase. Likewise, the peroxidase may be anionic peroxidase, ascorbate peroxidase, and cationic peroxidase. SEQ ID NOs: 1-252, 756 and 768 provide examples of such polynucleotides.

In accordance with another embodiment, a polynucleotide of the invention encodes the catalytic or protein binding domain of a polypeptide encoded by any of SEQ ID NOs: 1-252, 756 and 768 or of a polypeptide comprising any of SEQ ID NOs: 253-504, 766 and 769. The catalytic and protein binding domains of the monolignol synthesis, monolignol transport, and lignin polymerization proteins of the invention are known in the art. The conserved sequences of these proteins are shown in FIGS. 1-226 as underlined text.

The invention also includes conservative variant polynucleotides that differ from the sequences discussed above but that, as a consequence of the degeneracy of the genetic code, encode a polypeptide which is the same as that encoded by a polynucleotide of the present invention. The invention also includes as conservative variants polynucleotides comprising sequences that differ from the polynucleotide sequences discussed above as a result of substitutions that do not affect the amino acid sequence of the encoded polypeptide sequence, or that result in conservative substitutions in the encoded polypeptide sequence.

The present invention also includes an isolated polypeptide encoded by a polynucleotide comprising any of SEQ ID NOs: 1-252, 756 and 768 or any of the conservative variants thereof discussed above. The invention also includes polypeptides comprising SEQ ID NOs: 253-504, 766 and 769 and conservative variants of these polypeptides.

In accordance with the invention, a variant polypeptide or protein refers to an amino acid sequence that is altered by the addition, deletion or substitution of one or more amino acids.

The invention includes conservative variant polypeptides. As used herein, the term "conservative variant polypeptide" refers to a polypeptide that has similar structural, chemical or biological properties to the protein it is a conservative variant of. Guidance in determining which amino acid residues can be substituted, inserted, or deleted can be found using computer programs well known in the art such as Vector NTI Suite (InforMax, MD) software. In one embodiment of the invention, conservative variant polypeptides that exhibit at least about 75% sequence identity to their respective reference sequences.

Conservative variant protein includes an "isoform" or "analog" of the polypeptide. Polypeptide isoforms and analogs refers to proteins having the same physical and physiological properties and the same biological function, but whose amino acid sequences differs by one or more amino acids or whose sequence includes a non-natural amino acid.

Polypeptides comprising sequences that differ from the polypeptide sequences of SEQ ID NO: 253-504, 766 and 769 as a result of amino acid substitutions, insertions, and/or deletions totaling less than 10% of the total sequence length are contemplated by and encompassed within the present invention.

One aspect of the invention provides conservative variant polypeptides function in monolignol synthesis, monolignol transport, and/or lignin polymerization, as determined by one or more appropriate assays, such as those described below. The invention includes variant polypeptides which are monolignol synthesis, monolignol transport, and lignin polymerization proteins, such as those capable of conjugating p-courmarate and Co-enzyme A or those peptides having an O-methyltransferase biological activity. As discussed above, the invention includes variant polynucleotides which encode polypeptides that function as monolignol synthesis, monolignol transport and lignin polymerization proteins.

The activities and physical properties of monolignol synthesis, monolignol transport and lignin polymerization proteins can be examined using any method known in the art. The following examples of assay methods are not exhaustive and are included to provide some guidance in examining the activity and distinguishing protein characteristsics of monolignol synthesis, monolignol transport and lignin polymerization proteins variants.

Phenylalanine ammonia lyase (PAL), and other monolignol synthesis, monolignol transport and lignin polymerization, activity can be measured using a radiometric assay. Briefly, leaf and flower samples are collected and snap frozen in liquid nitrogen. PAL activity can then be measured in cell extracts by a radiometric assay as described in Dixon et al., *Physiol. Plant Pathol.* 13:295-306 (1978). Cinnamoyl alcohol dehydrogenase (CAD) assays can be carried out in 1 mL of 100 mM Tris-HCl pH 8.8, containing 50 to 100 µL of plant extract, 0.1 mM coniferyl alcohol, and 0.02 mM NADP and monitored at 400 nm over 15 min at 30° C. See, e.g., Abbott et al., *Plant Physiol.* 128(3):844-53 (2002). Caffeate/5-hydroxyferulate O-methyltransferase (COMT) can be assayed by the protocol of Fukuda H. and A. Komamine, *Planta* 155:423-430 (1982), with minor modifications. Cinnamoyl-coenzyme A reductase (CCR) assays (350 µL) can contain 100 mM KH2PO4-Na2HPO4, pH 6.25; 5 mM dithiothreitol; 100 µM NADPH; 30 µM 14 C feruloyl coenzyme A (13,000 dpm); and 30 µL of plant extract. See, e.g., Abbott et al., *Plant Physiol.* 128(3):844-53 (2002). Control reactions can be carried out by omitting NADPH. These assay reactions can be incubated at about 30° C. for about 10 min, stopped with about 1 mL of ethyl acetate, vortexed, and partitioned by centrifugation. About five hundred microliters of the organic phase can be counted in 4.5 mL of Ecoscint scintillator (National Diagnostics, Hull, Herts, UK).

II. Methods of Using Monolignol Synthesis, Monolignol Transport, and Lignin Polymerization Genes, Polynucleotide and Polypeptide Sequences The present invention provides methods of using monolignol synthesis, monolignol transport, and lignin polymerization genes and conservative variants thereof. The invention includes methods and constructs for altering expression of monolignol synthesis, monolignol transport, and lignin polymerization, and monolignol synthesis, monolignol transport, and lignin polymerization-like genes and/or gene products for purposes including, but not limited to (i) investigating function during monolignol synthesis, monolignol transport, and lignin polymerization and ultimate effect on plant phenotype and (ii) to effect a change in plant phenotype. For example, the invention includes methods and tools for modifying wood quality, fiber development, secondary cell wall lignin content, and plant growth and yield by altering expression of one or more monolignol synthesis, monolignol transport, and lignin polymerization genes.

The invention comprises methods of altering the expression of any of the monolignol synthesis, monolignol transport, and lignin polymerization genes and variants discussed above. Thus, for example, the invention comprises altering expression of a monolignol synthesis, monolignol transport, or lignin polymerization gene present in the genome of a wild-type plant of a species of *Eucalyptus* or *Pinus*. In one embodiment, the monolignin synthesis, monolignol transport, or lignin polymerization gene comprises a nucleotide sequence selected from SEQ ID NOs: 1-252, 756 and 768 sequences or the conservative variants thereof, as discussed above.

A. Techniques to Alter Gene Expression

Techniques which can be employed in accordance with the present invention to alter gene expression, include, but are not limited to: (i) over-expressing a gene product, (ii) disrupting a gene's transcript, such as disrupting a gene's mRNA transcript; (iii) disrupting the function of a polypeptide encoded by a gene, or (iv) disrupting the gene itself. Over-expression of a gene product, the use of antisense RNAs, ribozymes, and the use of double-stranded RNA interference (dsRNAi) are valuable techniques for discovering the functional effects of a gene and for generating plants with a phenotype that is different from a wild-type plant of the same species.

Over-expression of a target gene often is accomplished by cloning the gene or cDNA into an expression vector and introducing the vector into recipient cells. Alternatively, over-expression can be accomplished by introducing exogenous promoters into cells to drive expression of genes residing in the genome. The effect of over-expression of a given gene on cell function, biochemical and/or physiological properties can then be evaluated by comparing plants transformed to over-express the gene to plants that have not been transformed to over-express the gene.

Antisense RNA technology involves expressing in, or introducing into, a cell an RNA molecule (or RNA derivative) that is complementary to, or antisense to, sequences found in a particular mRNA in a cell. The antisense RNA can inhibit translation of the encoded gene product. The use of antisense technology to reduce or inhibit the expression of specific plant genes has been described, for example in European Patent Publication No. 271988, Hu et al., *Nature Biotechnol.* 17:808-812 (1999); Sederoff, R. R., *Nature Biotechnol:* 17:750-751 (1999); Smith et al., *Nature,* 334:724-726 (1988); Smith et. al., *Plant Mol. Biol.,* 14:369-379 (1990)).

A ribozyme is an RNA that has both a catalytic domain and a sequence that is complementary to a particular mRNA. The ribozyme functions by associating with the mRNA (through the complementary domain of the ribozyme) and then cleaving (degrading) the message using the catalytic domain. RNA interference (RNAi) involves a post-transcriptional gene silencing (PTGS) regulatory process, in which the steady-state level of a specific mRNA is reduced by sequence-specific degradation of the transcribed, usually fully processed mRNA without an alteration in the rate of de novo transcription of the target gene itself. The RNAi technique is discussed, for example, in Elibashir, et al., *Methods Enzymol.* 26: 199 (2002); McManus & Sharp, *Nature Rev. Genetics* 3: 737 (2002); PCT application WO 01/75164; Martinez et al., *Cell* 110: 563 (2002); Elbashir et al., supra; Lagos-Quintana et al., *Curr. Biol.* 12: 735 (2002); Tuschl et al., Nature Biotechnol. 20:446 (2002); Tuschl, *Chembiochem.* 2: 239

(2001); Harborth et al., *J. Cell Sci.* 114: 4557 (2001); et al., *EMBO J.* 20:6877 (2001); Lagos-Quintana et al., *Science.* 294: 8538 (2001); Hutvagner et al., loc cit, 834; Elbashir et al., *Nature.* 411: 494 (2001).

B. Assembly of DNA Constructs

The present invention provides a DNA construct comprising at least one polynucleotide of SEQ ID NOs: 1-252, 756 and 768 or conservative variants thereof, such as the conservative variants discussed above. Any method known in the art can be used to generate the DNA constructs of the present invention. See, e.g. Sambrook et al., supra.

The invention includes DNA constructs that optionally comprise a promoter. Any suitable promoter known in the art can be used. A promoter is a nucleic acid, preferably DNA, that binds RNA polymerase and/or other transcription regulatory elements. As with any promoter, the promoters of the invention facilitate or control the transcription of DNA or RNA to generate an mRNA molecule from a nucleic acid molecule that is operably linked to the promoter. The RNA can encode a protein or polypeptide or can encode an antisense RNA molecule or a molecule useful in RNAi. Promoters useful in the invention include constitutive promoters, inducible promoters, temporally regulated promoters and tissue-preferred promoters.

Examples of useful constitutive plant promoters include: the cauliflower mosaic virus (CaMV) 35S promoter, which confers constitutive, high-level expression in most plant tissues (Odel et al. *Nature* 313:810 (1985)); the nopaline synthase promoter (An et al. *Plant Physiol.* 88:547 (1988)); and the octopine synthase promoter (Fromm et al., *Plant Cell* 1: 977 (1989)). It should be noted that, although the CaMV 35S promoter is commonly referred to as a constitutive promoter, some tissue preference can be seen. The use of CaMV 35S is envisioned by the present invention, regardless of any tissue preference which may be exhibited during use in the present invention.

Inducible promoters regulate gene expression in response to environmental, hormonal, or chemical signals. Examples of hormone inducible promoters include auxin-inducible promoters (Baumann et al. *Plant Cell* 11:323-334 (1999)), cytokinin-inducible promoters (Guevara-Garcia, *Plant Mol. Biol.* 38:743-753 (1998)), and gibberellin-responsive promoters (Shi et al. *Plant Mol. Biol.* 38:1053-1060 (1998)). Additionally, promoters responsive to heat, light, wounding, pathogen resistance, and chemicals such as methyl jasmonate or salicylic acid, can be used in the DNA constructs and methods of the present invention.

Tissue-preferred promoters allow for preferred expression of polynucleotides of the invention in certain plant tissue. Tissue-preferred promoters are also useful for directing the expression of antisense RNA or siRNA in certain plant tissues, which can be useful for inhibiting or completely blocking the expression of targeted genes as discussed above. As used herein, vascular plant tissue refers to xylem, phloem or vascular cambium tissue. Other preferred tissue includes apical meristem, root, seed, and flower. In one aspect, the tissue-preferred promoters of the invention are either "xylem-preferred," "cambium-preferred" or "phloem-preferred," and preferentially direct expression of an operably linked nucleic acid sequence in the xylem, cambium or phloem, respectively. In another aspect, the DNA constructs of the invention comprise promoters that are tissue-specific for xylem, cambium or phloem, wherein the promoters are only active in the xylem, cambium or phloem.

A vascular-preferred promoter is preferentially active in any of the xylem, phloem or cambium tissues, or in at least two of the three tissue types. A vascular-specific promoter is specifically active in any of the xylem, phloem or cambium, or in at least two of the three. In other words, the promoters are only active in the xylem, cambium or phloem tissue of plants. Note, however, that because of solute transport in plants, a product that is specifically or preferentially expressed in a tissue may be found elsewhere in the plant after expression has occurred.

Additionally, the promoters of particular monolignol synthesis, monolignol transport, and lignin polymerization genes may be expressed only within the cambium in developing secondary vasculature. Within the cambium, particular monolignol synthesis, monolignol transport, and lignin polymerization gene promoters may be expressed exclusively in the stem or in the root. Moreover, the monolignol synthesis, monolignol transport, and lignin polymerization promoters may be expressed only in the spring (for early wood formation) or only in the summer.

A promoter may be operably linked to the polynucleotide. As used in this context, "operably linked" refers to linking a polynucleotide encoding a structural gene to a promoter such that the promoter controls transcription of the structural gene. If the desired polynucleotide comprises a sequence encoding a protein product, the coding region can be operably linked to regulatory elements, such as to a promoter and a terminator, that bring about expression of an associated messenger RNA transcript and/or a protein product encoded by the desired polynucleotide. In this instance, the polynucleotide is operably linked in the 5'- to 3'-orientation to a promoter and, optionally, a terminator sequence. Accordingly, one or more elements can be operably linked in order to control the transcription of a structural gene.

Alternatively, the invention provides DNA constructs comprising a polynucleotide in an "antisense" orientation, the transcription of which produces nucleic acids that can form secondary structures that affect expression of an endogenous monolignol synthesis, monolignol transport or lignin polymerization gene in the plant cell. In another variation, the DNA construct may comprise a polynucleotide that yields a double-stranded RNA product upon transcription that initiates RNA interference of a monolignol synthesis, monolignol transport or lignin polymerization gene with which the polynucleotide is associated. A polynucleotide of the present invention can be positioned within a t-DNA, such that the left and right t-DNA border sequences flank or are on either side of the polynucleotide.

It should be understood that the invention includes DNA constructs comprising one or more of any of the polynucleotides discussed above, e.g., SEQ ID NO: 1-252, 756 and 768. The invention includes DNA constructs comprising one or more of any of the polynucleotides discussed above, e.g., SEQ ID NO: 1-252, 756 and 768, and one or more t-DNA borders that facilitate integration into a plant genome.

The invention also includes DNA constructs comprising a promoter that includes one or more regulatory elements. Alternatively, the invention includes DNA constructs comprising a regulatory element that is separate from a promoter. Regulatory elements confer a number of important characteristics upon a promoter region. Some elements bind transcription factors that enhance the rate of transcription of the operably linked nucleic acid. Other elements bind repressors that inhibit transcription activity. The effect of transcription factors on promoter activity can determine whether the promoter activity is high or low, i.e. whether the promoter is "strong" or "weak."

A DNA construct of the invention can include a nucleotide sequence that serves as a selectable marker useful in identifying and selecting transformed plant cells or plants. Numerous selectable markers are known in the art. See, e.g., B. Miki and S. McHugh, *J. Biotechnol.* 107(3):193-232 (2004). Selectable marker genes can confer positive or negative selection of transformed plant cells or plants. Selectable makers genes and gene products can be conditional or non-conditional on the presence of external substrates. As used herein, a "positive selectable marker gene" promotes the growth of transformed tissue. In contrast, a "negative selectable marker gene" results in the death of the transformed tissue. Positive selectable marker genes can be conditional on the use of toxic agents, such as antibiotics, herbicides or drugs. In addition, positive selectable marker genes can be conditional on non-toxic agents that may be substrates for growth or that induce growth and differentiation of the transformed plant cells or plants. Positive selectable marker genes can also alter the physiological processes that govern plant development. Examples of such selectable markers include, but are not limited to, a neomycin phosphotransferase (nptII) gene (Potrykus et al., *Mol. Gen. Genet.* 199:183-188 (1985)), which confers kanamycin resistance. Cells expressing the nptII gene can be selected using an appropriate antibiotic such as kanamycin or G418. Other commonly used selectable markers include a mutant EPSP synthase gene (Hinchee et al., *Bio/Technology* 6:915-922 (1988)), which confers glyphosate resistance; and a mutant acetolactate synthase gene (ALS), which confers imidazolinone or sulphonylurea resistance (European Patent Application No. 154,204).

The present invention also includes vectors comprising the DNA constructs discussed above. The vectors can include an origin of replication (replicons) for a particular host cell. Various prokaryotic replicons are known to those skilled in the art, and function to direct autonomous replication and maintenance of a recombinant molecule in a prokaryotic host cell. See, e.g. Sambrook et al., supra.

For example, pMON530 is an *Agrobacterium*-based plant transformation vector for use in transformation of dicotyledonous plants is plasmid vector (Rogers et al. "Improved vectors for plant transformation: expression cassette vectors and new selectable markers.," in METHODS IN ENZYMOLOGY. Ed. R. Wu and L. Grossman. p 253-277. San Diego: Academic Press). Another useful plasmid is pMON530, a derivative of pMON505, prepared by transferring the 2.3 kb StuI-HindIII fragment of pMON316 into pMON526. Plasmid pMON526 is a simple derivative of pMON505 in which the SmaI site is removed by digestion with XmaI, treatment with Klenow polymerase and ligation. Plasmid pMON530 retains all the properties of pMON505 and the CaMV35S-NOS expression cassette, but contains a unique cleavage site for SmaI between the promoter and polyadenylation signal.

Binary vector pMON505 is a derivative of pMON200 (Rogers et al., supra,) in which the Ti plasmid homology region, LIH, is replaced with a 3.8 kb HindIII to SmaI segment of the mini RK2 plasmid, pTJS75 (Schmidhauser and Helinski. (1985) *J. Bacteriol.* 164-155). This segment contains the RK2 origin of replication, oriV, and the origin of transfer, oriT, for conjugation into *Agrobacterium* using the tri-parental mating procedure. Horsch and Klee., *Proc. Natl. Acad. Sci. U.S.A.*, 83:4428 (1986). Plasmid pMON505 retains all the important features of pMON200 including the synthetic multi-linker for insertion of desired DNA fragments, the chimeric NOS/NPTII'/NOS gene for kanamycin resistance in plant cells, the spectinomycin/streptomycin resistance determinant for selection in *E. coli* and *A. tumefaciens*, an intact nopaline synthase gene for facile scoring of transformants and inheritance in progeny, and a pBR322 origin of replication for ease in making large amounts of the vector in *E. coli*. Plasmid pMON505 contains a single T-DNA border derived from the right end of the pTiT37 nopaline-type T-DNA. Southern blot analyses demonstrate that plasmid pMON505 and any DNA that it carries are integrated into the plant genome, that is, the entire plasmid is the T-DNA that is inserted into the plant genome. One end of the integrated DNA is located between the right border sequence and the nopaline synthase gene and the other end is between the border sequence and the pBR322 sequences. A similar mechanism uses the cre recombinase to integrate constructs into the plant genome. See, e.g., Gleave et al., *Plant Mol. Biol.* 40(2):223-35 (1999).

A particularly useful Ti plasmid cassette vector is pMON17227. This vector is described in WO 92/04449 and contains a gene encoding an enzyme conferring glyphosate resistance (denominated CP4), which is an excellent selection marker gene for many plants, including potato and tomato. The gene is fused to the *Arabidopsis* EPSPS chloroplast transit peptide (CTP2), and expression is driven by the promoter of choice.

In one embodiment, the present invention utilizes a pWVR8 vector as described in Gleave, *Plant Mol. Biol.*, 20:1203-27 (1992), Wesley et al., *Plant J.* 27(6):581-90. (2001).

In another embodiment, the inventive materials and techniques are directed to DNA constructs for stacking one or more monolignol synthesis, monolignol transport, and lignin polymerization genes simultaneously in transgenic plant cells and plants. See, e.g., Li et al., *Proc. Natl. Acad. Sci. U.S.A.* 100:4939-4944 (2003).

C. Transformed Host Cells, Plant Tissue and Plants

The invention also provides host cells which are transformed with the DNA constructs of the invention. As used herein, a host cell refers to the cell in which a polynucleotide of the invention is expressed. Accordingly, a host cell can be an individual cell, a cell culture or cells that are part of an organism. The host cell can also be a portion of an embryo, endosperm, sperm or egg cell, or a fertilized egg. In one embodiment, the host cell is a plant cell.

The present invention further provides transgenic plants comprising the DNA constructs of the invention. The invention includes transgenic plants that are angiosperms or gymnosperms. The DNA constructs of the present invention can be used to transform a variety of plants, both monocotyledonous (e.g. grasses, corn, grains, oat, wheat and barley), dicotyledonous (e.g., *Arabidopsis*, tobacco, legumes, alfalfa, oaks, eucalyptus, maple), and Gymnosperms (e.g., U.S. Pat. No. 6,518,485), white spruce (Ellis et al., *Biotechnology* 11:84-89 (1993)), and larch (Huang et al., *In Vitro Cell* 27:201-207, 1991).

The plants also include turfgrass, wheat, maize, rice, sugar beet, potato, tomato, lettuce, carrot, strawberry, cassava, sweet potato, geranium, soybean, and various types of woody plants. Woody plants include trees such as palm oak, pine, maple, fir, apple, fig, plum and acacia. Woody plants also include rose and grape vines.

In one embodiment, the DNA constructs of the invention are used to transform woody plants, i.e., trees or shrubs whose stems live for a number of years and increase in diameter each year by the addition of woody tissue. The invention includes methods of transforming plants including eucalyptus and pine species of significance in the commercial forestry industry such as plants selected from the group consisting of *Eucalyptus grandis* and its hybrids, and *Pinus taeda*, as well as the transformed plants and wood and wood pulp derived therefrom. Other examples of suitable plants include those selected from the group consisting of *Pinus banksiana*, *Pinus brutia*, *Pinus caribaea*, *Pinus clausa*, *Pinus contorta*, *Pinus*

*coulteri, Pinus echinata, Pinus eldarica, Pinus ellioti, Pinus jeffreyi, Pinus lambertiana, Pinus massoniana, Pinus monticola, Pinus nigra, Pinus palustris, Pinus pinaster, Pinus ponderosa, Pinus radiata, Pinus resinosa, Pinus rigida, Pinus serotina, Pinus strobus, Pinus sylvestris, Pinus taeda, Pinus virginiana, Abies amabilis, Abies balsamea, Abies concolor, Abies grandis, Abies lasiocarpa, Abies magnifica, Abies procera, Chamaecyparis lawsoniona, Chamaecyparis nootkatensis, Chamaecyparis thyoides, Juniperus virginiana, Larix decidua, Larix laricina, Larix leptolepis, Larix occidentalis, Larix siberica, Libocedrus decurrens, Picea abies, Picea engelmanni, Picea glauca, Picea mariana, Picea pungens, Picea rubens, Picea sitchensis, Pseudotsuga menziesii, Sequoia gigantea, Sequoia sempervirens, Taxodium distichum, Tsuga canadensis, Tsuga heterophylla, Tsuga mertensiana, Thuja occidentalis, Thuja plicata, Eucalyptus alba, Eucalyptus bancroftii, Eucalyptus botryoides, Eucalyptus bridgesiana, Eucalyptus calophylla, Eucalyptus camaldulensis, Eucalyptus citriodora, Eucalyptus cladocalyx, Eucalyptus coccifera, Eucalyptus curtisii, Eucalyptus dalrympleana, Eucalyptus deglupta, Eucalyptus delegatensis, Eucalyptus diversicolor, Eucalyptus dunnii, Eucalyptus ficifolia, Eucalyptus globulus, Eucalyptus gomphocephala, Eucalyptus gunnii, Eucalyptus henryi, Eucalyptus laevopinea, Eucalyptus macarthurii, Eucalyptus macrorhyncha, Eucalyptus maculata, Eucalyptus marginata, Eucalyptus megacarpa, Eucalyptus melliodora, Eucalyptus nicholii, Eucalyptus nitens, Eucalyptus nova-angelica, Eucalyptus obliqua, Eucalyptus occidentalis, Eucalyptus obtusiflora, Eucalyptus oreades, Eucalyptus pauciflora, Eucalyptus polybractea, Eucalyptus regnans, Eucalyptus resinifera, Eucalyptus robusta, Eucalyptus rudis, Eucalyptus saligna, Eucalyptus sideroxylon, Eucalyptus stuartiana, Eucalyptus tereticornis, Eucalyptus torelliana, Eucalyptus urnigera, Eucalyptus urophylla, Eucalyptus viminalis, Eucalyptus viridis, Eucalyptus wandoo,* and *Eucalyptus youmanni.*

As used herein, the term "plant" also is intended to include the fruit, seeds, flower, strobilus, etc. of the plant. A transformed plant of the current invention can be a direct transfectant, meaning that the DNA construct was introduced directly into the plant, such as through particle bombardment or by *Agrobacterium*-mediated transformation, or the plant can be the progeny of a transfected plant. The second or subsequent generation plant can be produced by sexual reproduction, i.e., fertilization. Furthermore, the plant can be a gametophyte (haploid stage) or a sporophyte (diploid stage).

As used herein, the term "plant tissue" encompasses any portion of a plant, including plant cells. Plant cells include suspension cultures, callus, embryos, meristematic regions, callus tissue, leaves, roots, shoots, gametophytes, sporophytes, pollen, seeds and microspores. Plant tissues can be grown in liquid or solid culture, or in soil or suitable media in pots, greenhouses or fields. As used herein, "plant tissue" also refers to a clone of a plant, seed, progeny, or propagule, whether generated sexually or asexually, and descendents of any of these, such as cuttings or seeds.

In one aspect of the invention, somatic embryogenesis can be used for the clonal propagation of the inventive transgenic plants and plant tissue. See, e.g., S. A. Merkle and J. F. Dean, *Curr. Opin. Biotechnol.* 11(3):298-302 (2000).

Likewise, the regeneration of plants is well established for many species. See Dunsten et al., Somatic embryogenesis in woody plants, In *in vitro embryogenesis of plants* (Current Plant Science and Biotechnology in Agriculture, 12), Kluwer Academic Publishers, Boston, Mass. (1995).

As used herein, "transformation" refers to a process by which a nucleic acid is inserted or incorporated into the genome of a plant cell. Such insertion encompasses stable introduction into the plant cell and transmission to progeny. Transformation also refers to transient insertion of a nucleic acid, wherein the resulting transformant transiently expresses the nucleic acid. Transformation can occur under natural or artificial conditions using various methods well known in the art. See, e.g., Glick and Thompson, eds., METHODS IN PLANT MOLECULAR BIOLOGY, CRC Press, Boca Raton, Fla. (1993)). Transformation can be achieved by any known method for the insertion of nucleic acid sequences into a prokaryotic or eukaryotic host cell, including *Agrobacterium*-mediated transformation protocols (see., e.g., Horsch et al., *Science,* 227:1229-31 (1985), viral infection, whiskers, calcium phosphate precipitation, electroporation (see, e.g., Rhodes et al., *Science* 240(4849):204-207 (1988), microinjection, polyethylene glycol-treatment (see, e.g., Lyznik et al., *Plant Mol. Biol.* 13:151-161 (1989), heat shock, lipofection, and particle bombardment or other biolistic method (see, e.g., Klein et al., *Plant Physiol.* 91:440-444 (1989) and Boynton et al., *Science* 240(4858):1534-1538 (1988)). Transformation can also be accomplished using chloroplast transformation, as described in e.g. Svab et al., *Proc. Natl. Acad. Sci.* 87:8526-30 (1990), and through the use of protoplast transformation systems.

Plant transformation strategies are described in, for example, U.S. Pat. Nos. 5,159,135 (cotton), 5,981,840 (corn), 5,914,451 (soybean), and WO 00/12715 (eucalyptus), which are incorporated by reference in their entirety. Additional plant transformation strategies and techniques are reviewed in Birch, R. G., *Ann. Rev. Plant Physiol. Plant Mol. Biol.* 48:297 (1997) and Forester et al., *Exp. Agric.* 33:15-33 (1997), and are incorporated by reference in their entirety.

Methods for transforming tree species are known in the art. In accordance with one embodiment of the invention, genotype-independent transformation of *Eucalyptus* explants and generation of transgenic progeny can be accomplished by transformation using *Agrobacterium*. A tree explant can be, although need not be, harvested and cultured on a pre-culture medium before transformation. Although a pre-culture medium is not necessary, use of such a medium can increase transformation efficiency and plant regeneration. A pre-culture medium is a nutrient medium upon which plant explants can be cultured before transformation with *Agrobacterium*. Any pre-culture media and time periods of culture can be used. The pre-culture medium contains an *Agrobacterium* inducer, such as acetosyringone. The pre-culture medium can optionally contain plant growth regulators, including auxin and cytokinin. Pre-culture medium can be prepared using and appropriate salt medium, including, but not limited to Woody Plant Medium (WPM) salts (Lloyd and McCown, *Combined Proceedings of the International Plant Propagators Society,* 30:421-427, 1980), Murashige and Skoog medium (Sigma Aldrich, St. Louis, Mo.) or Lepoivre medium. The pre-culture medium can contain *Agrobacterium* inducers, such as, for example acetosyringone. Optionally, pre-culture medium can contain auxin, cytokinin, or both auxin and cytokinin. An exemplary plant pre-culture medium is shown below.

| Medium Components | Amount per Liter of Medium |
|---|---|
| WPM salts | 1 package (Sigma) |
| $Ca(NO_3)_2 \cdot 4H_2O$ | 3.7 g |
| $MgSO_4 \cdot 4H_2O$ | 0.37 g |
| Nicotinic Acid | 0.5 mg |
| Thiamine•HCl | 0.5 mg |

-continued

| Medium Components | Amount per Liter of Medium |
|---|---|
| Pyridoxin•HCl | 0.5 mg |
| D-Pantothenic Acid | 1.0 mg |
| Myo-inositol | 0.1 g |
| BA | 0.1-1 mg |
| Bacto-agar | 5-8 g |
| Acetosyringone | 5-200 mg |
| NAA | 0.2-3 mg |
| zeatin | 1-6 mg |

In this transformation method, plant explants can be pre-cultured for four days in the dark on the pre-culture medium. Induced *Agrobacterium* culture can be prepared by methods known in the art. The induced culture is applied to a plant explant. Explants can be transformed by application of *Agrobacterium* culture to the explant, vacuum infiltration, floral dip, etc. Following transformation, *Agrobacterium* culture-treated explants can be co-cultivated with *Agrobacterium* under light or dark conditions for 2-10 days. In one embodiment, the explants are co-cultivated with *Agrobacterium* under light or dark conditions for 4 days.

Following co-cultivation, explants can be transferred to regeneration medium with 400 mg/L timentin. Explants can be cultured on regeneration medium before transfer to a selection medium. In one embodiment, explants are cultured on regeneration medium for four days. Any suitable selection medium can be used. In one embodiment, the selection medium is the regeneration medium supplemented with both timentin and an herbicide selection agent. The table below provides an exemplary regeneration medium.

| Components for 1 Liter of Medium | Grams |
|---|---|
| KNO$_3$ | 1 |
| NH$_4$H$_2$PO$_4$ | 0.25 |
| MgSO$_4$•7H$_2$O | 0.25 |
| CaCl$_2$•2H$_2$O | 0.10 |
| FeSO$_4$•7H$_2$O | 0.0139 |
| Na$_2$EDTA•2H$_2$O | 0.01865 |
| MES (Duchefa m1501) | 600.0 |
| MS Micro (1/2 strength) | |
| MnSO$_4$•H$_2$O | 0.00845 |
| ZnSO$_4$•7H$_2$O | 0.0043 |
| CuSO$_4$•5H$_2$O | 0.0000125 |
| CoCl$_2$•6H$_2$O | 0.0000125 |
| KI | 0.000415 |
| H$_3$BO$_3$ | 0.0031 |
| Na$_2$MoO$_4$•2H$_2$O | 0.000125 |
| Plant Growth Regulators | |
| Zeatin | |
| NAA (naphthalene acetic acid) | |
| Sugars | |
| Glucose/Sucrose | 20.0 |
| Myo-inositol | 0.100 |
| Amino Acid and Vitamin Mix | |
| Nicotinic Acid | 0.010 |
| Thiamine | 0.010 |
| Ca Pantothenate | 0.001 |
| Pyridoxine | 0.001 |
| Biotin | 0.00001 |
| Ascorbic Acid | 0.050 |
| L-glutamine | 0.1 |
| Arginine | 0.0258 |
| Glycine | 0.00199 |

-continued

| Components for 1 Liter of Medium | Grams |
|---|---|
| Lysine | 0.0508 |
| Methionine | 0.0132 |
| Phenylalanine | 0.0257 |
| Serine | 0.00904 |
| Threonine | 0.00852 |
| Tryptophan | 0.0122 |
| Tyrosine | 0.0127 |
| Gelling Agent | |
| Gelrite | 3.0 |

Shoot clumps that survive selection are maintained on regeneration medium containing herbicide and timentin. The shoot clumps can be transferred until shoots proliferate and initially elongate. In one embodiment, the shoot clumps are transferred every 3 weeks.

Any reporter gene can be used, such as, for example, GFP, luciferase, or GUS. See, e.g., B. Miki and S. McHugh, *J. Biotechnol.* 107(3):193-232 (2004).

In one embodiment, GUS staining can performed to monitor the frequency of *Agrobacterium* infection and to ensure that the selected shoots are not escapes or chimeras. Leaf and stem tissues from the regenerated shoots can be stained for reporter gene expression immediately upon shoot development. For example, to determine GUS activity, the explants can be incubated in a substrate comprising 100 mM phosphate buffer (pH 7.0), 0.05% dimethyl suphoxide, 0.05% Triton X-100, 10 mM EDTA, 0.5 mM potassium ferrocyanide, and 1.5 mg/ml 5-bromo-4-chloro-3-indolyl-β-D-glucuronide (X-gluc). The explants can then be subjected to 10 minutes of vacuum before an overnight incubation at 37° C. prior to counting GUS foci.

In accordance with another embodiment, transformation of *Pinus* is accomplished using the methods described in U.S. Patent Application Publication No. 2002/0100083.

D. Modulation of Plant Phenotype

In accordance with another aspect of the invention, a transgenic plant that has been transformed with a DNA construct of the invention has a phenotype that is different from a plant that has not been transformed with the DNA construct.

As used herein, "phenotype" refers to a distinguishing feature or characteristic of a plant which can be altered according to the present invention by integrating one or more DNA constructs of the invention into the genome of at least one plant cell of a plant. The DNA construct can confer a change in the phenotype of a transformed plant by modifying any one or more of a number of genetic, molecular, biochemical, physiological, morphological, or agronomic characteristics or properties of the transformed plant cell or plant as a whole.

1. Modulating Lignin Content, Lignin Compositions and Various Economic and Non-Economic Traits In one embodiment, transformation of a plant with an inventive DNA contruct can yield a phenotype including, but not limited to, increased or decreased lignin content or lignin composition. As used herein, "lignin content" referes to the relative amount of lignin polymer present relative to nonlignin components of the plant such as, for example, cellulose, hemicellulose, or nonlignin cell wall phenolics.

In contrast and as used herein, "lignin composition" refers to the relative percentages of each lignin subunit, i.e., p-hydroxyphenyl, guaiacyl, and syringyl, among others. The inventive methods are used to modulate the relative percentages of each subunit monomer in the final polymerized lignin, i.e., change the syringyl-to-guaiacyl ratio (S/G ratio). In one embodiment, the inventive methods are used to direct the production and incorporation of sinapyl alcohol so that the lignin of a transformed plant comprises a greater percentage of syringyl monomers than a wild-type plant. In a further embodiment, the inventive methods comprise directing the production of sinapyl alcohol in a transformed plant which would otherwise have lignin with little to no syringyl monomers.

In one embodiment, transformation of a plant with a DNA construct of the present invention can yield a phenotype including, but not limited to any one or more of increased drought tolerance, herbicide resistance, reduced or increased height, reduced or increased branching, enhanced cold and frost tolerance, improved vigor, enhanced or altered color, enhanced health and nutritional characteristics, improved storage, enhanced yield, enhanced salt tolerance, enhanced resistance of the wood to decay, enhanced resistance to fungal diseases, altered attractiveness to insect pests, increased disease tolerance, increased insect tolerance, increased water-stress tolerance, improved texture, increased germination, increased micronutrient uptake, production of novel resins, and production of novel proteins or peptides.

In another embodiment, the affected phenotype includes one or more of the following traits: propensity to form reaction wood (i.e., compression wood and tension wood), a reduced period of juvenility, an increased period of juvenility, self-abscising branches, accelerated or delayed reproductive development, as compared to a plant of the same species that has not been transformed with the DNA construct.

In a further embodiment, the phenotype that is different in the transgenic plant includes one or more of the following: lignin quality, lignin structure, wood composition, wood appearance, wood density, wood strength, wood stiffness, cellulose polymerization and accumulation, fiber dimensions, lumen size, proportion of rays, proportion of vessel elements, proportion of nonlignin cell wall phenolics, other plant components, plant cell division, plant cell development, number of cells per unit area, cell size, cell shape, cell wall composition, rate of wood formation, aesthetic appearance of wood, formation of stem defects, average microfibril angle, width of the S2 cell wall layer, rate of growth, rate of root formation ratio of root to branch vegetative development, leaf area index, and leaf shape.

2. Assessment of Phenotypic Change

Phenotype can be assessed by any suitable means. The plants can be evaluated based on their general morphology. Transgenic plants can be observed with the naked eye, can be weighed and their height measured. The plant can be examined by isolating individual layers of plant tissue, namely phloem and cambium, which is further sectioned into meristematic cells, early expansion, late expansion, secondary wall formation, and late cell maturation. See, e.g., Hertzberg, supra. The plants also can be assessed using microscopic analysis or chemical analysis.

Microscopic analysis includes examining cell types, stage of development, and stain uptake by tissues and cells. Fiber morphology, such as fiber wall thickness and microfibril angle of wood pulp fibers can be observed using, for example, microscopic transmission ellipsometry. See Ye and Sundström, *Tappi J.*, 80:181 (1997). Wood strength, density, and grain slope in wet wood and standing trees can be determined by measuring the visible and near infrared spectral data in conjunction with multivariate analysis. See, U.S. Patent Application Publication Nos. 2002/0107644 and 2002/0113212. Lumen size can be measured using scanning electron microscopy. Lignin structure and chemical properties can be observed using nuclear magnetic resonance spectroscopy as described in Marita et al., *J. Chem. Soc., Perkin Trans. I* 2939 (2001).

The biochemical characteristic of lignin, cellulose, carbohydrates and other plant extracts can be evaluated by any standard analytical method known including spectrophotometry, fluorescence spectroscopy, HPLC, mass spectroscopy, and tissue staining methods. See, e.g., R. J. Evans and T. A. Milne, *Energy & Fuels* 1(2):123-137 (1987).

The technique of molecular-beam, mass spectrometric (MBMS) sampling is particularly useful for the characterization of the cellulose, lignin and hemicellulose components of wood. See Evans and Milne, supra.

Techniques for the quantification of lignin content are well known to the skilled artisan. Acetyl bromide extraction (ABE) can be used to quantify lignin. ABE involves the extraction of lignin using aceyl bromide followed by the spectrophotometric measuring the absorbance of the extracted lignin at 280 nm. See K. Liyama and A. F. A. Wallis, *Wood Sci. Technol.* 22:271-280 (1988). Klason lignin determination is a method to quantify lignin consisting of hydrolyzing the cell wall polysaccharides with sulfuric acid. This leaves the lignin as an insoluble material which is dried and quantified gravimetriclly. See M. J. Effland, *T.A.P.P.I.* 60:143-144 (1977). Thioglycolic acid extraction (TAE) can be used to quantify lignin. In this method, lignin is extracted using tioglycolic acid and alkali and then measured spectrophotometrically. See Campbell, M. M. and B. E. Ellis, *Plant Physiol.* 98:62-70 (1992).

A skilled artisan also can use several methods to determine the lignin composition of the inventive transgenic plant cells and plants. Alkaline nitrobenzene oxidation (ANO) or culpric oxide oxidation can be used to determine lignin composition. See, e.g., Dence et al. (1992) *Methods of Lignin Chemistry*, Springer-Verlag, New York, N.Y. In ANO, lignin is oxidized with nitro benzene in alkali and the degredation products are measured after HPLC separation or gas chromatography. A skilled artisan can used derivation followed by reductive cleavage (DFRC) to determine lignin composition. In DFRC, the alpha- and beta-aryl ether linkages in lignin are cleaved by acetyle bromide and the released cinnamyl acetates are quantified by gas chromatography. See Lu, F. and J. Ralph, *J. Agric. Food Chem.* 45:2590-2592 (1997). Lignin composition can also be determined using fourier transform infrared (FTIR) and diffuse reflectance infrared Fourier transform (DRIFT) spectroscopy. Both FTIR and DRIFT rely an the absorption of energy from an illuminating laser. In FTIR, a ratio of absorbance intensities at different wavelengths is related to the concentration of different molecules in a sample. In DRIFT, absorbance spectra is generated by light reflecting from the surface of opaque materials. NMR spectroscopy can also provide information as to the composition of isolated lignin fractions. NMR allows the characterization of each lignin subunit (i.e., p-hydroxyphenyl, guaiacyl, and syringyl), the determination of functional groups (i.e., methoxy and hydroxyl), and the characterization of the main inter-subunit bonds. Thioacidolysis in yet another method for determining lignin composition. Thioacidolysis and subsequent gas chromatography can identify monomers that are released by selective breaking of the main inter-subunit bonds. This method is specific for phenylpropanoids and is very sensitive. See Lapierre et al., *Plant Physiol.* 119:153-163 (1999); Boudet et al., *New Phytol.* 129:203-236 (1995).

E. Compositions and Methods for Enhancing Wood or Wood Pulp

Another aspect of the invention provides methods of obtaining wood and/or making wood pulp from a plant transformed with a DNA construct of the invention. Methods of producing a transgenic plant are provided above and are known in the art. A transformed plant can be cultured or grown under any suitable conditions. For example, pine can be cultured and grown as described in U.S. Patent Application Publication No. 2002/0100083. *Eucalyptus* can be cultured and grown as in, for example, Rydelius, et al., "Growing *Eucalyptus* for Pulp and Energy," presented at the Mechanization in Short Rotation, Intensive Culture Forestry Conference, Mobile, Ala., 1994. Wood and wood pulp can be obtained from the plant by any means known in the art. For example, pulping processes known in the art include, but are not limited to mechanical pulping, thermomechanical pulping, enzymatic pulping, chemical pulping, or chemithermomechanical pulping. Moreover, multiple techniques of each pulping process are known, e.g., known chemical pulping process include acidic or bisulfate pulping, sulfate pulping, Kraft pulping, soda pulping, anthraquinone pulping, or Kraft-anthraquinone pulping.

As noted above, the wood or wood pulp obtained in accordance with this invention can demonstrate improved characteristics including, but not limited to any one or more of lignin composition, lignin structure, wood composition, cellulose polymerization, fiber dimensions, ratio of fibers to other plant components, increased or decreased nonlignin cell wall phenolics, plant cell division, plant cell development, number of cells per unit area, cell size, cell shape, cell wall composition, rate of wood formation, aesthetic appearance of wood, formation of stem defects, rate of growth, rate of root formation ratio of root to branch vegetative development, leaf area index, and leaf shape.

In other embodiments, the inventive wood or wood pulp can demonstrate improved characteristics, including increased or decreased lignin content, increased accessibility of lignin to chemical treatments, improved reactivity of lignin, increased or decreased cellulose content increased dimensional stability, increased tensile strength, increased shear strength, increased compression strength, increased shock resistance, increased stiffness, increased or decreased hardness, decreased spirality, decreased shrinkage, and differences in weight, density, and specific gravity.

In yet another embodiment, the inventive wood or wood pulp comprises lignin of an altered S/G ratio, an increased S/G ratio, or a decreased S/G ratio, as compared to wood or wood pulp from a wild-type plant. Specifically, the inventive wood or wood pulp can comprise lignin with increased S/G ratio such that the wood or wood pulp degrades faster than that from a wild-type plant. In another embodiment, the inventive wood or wood pulp can comprise lignin with increased S/G ratio such that the wood or wood pulp more efficiently undergoes delignification. In one embodiment, the inventive methods are used to direct the production and incorporation of sinapyl alcohol so that the lignin of a transformed plant comprises a greater percentage of syringyl monomers than a corresponding non-transformed plant. In another embodiment, the inventive methods are used to increase the lignin content of a transformed plant about at least 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 55%, 60%, 65%, and 70%, as compared to a corresponding non-transformed plant. In another embodiment, the inventive methods are used to decrease the lignin content of a transformed plant about at least 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 55%, 60%, 65%, and 70%, as compared to a corresponding non-transformed plant. In yet another embodiment, the inventive methods are used to alter the lignin composition by increasing the relative percentage of syringyl lignin of a transformed plant about at least 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 55%, 60%, 65%, and 70%, as compared to a corresponding non-transformed plant. In another embodiment, the inventive methods are used to alter the lignin composition by decreasing the relative percentage of syringyl lignin of a transformed plant about at least 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 55%, 60%, 65%, and 70%, as compared to a corresponding non-transformed plant. Those skilled in the art would understand that lignin levels vary in different species, clones and plantings.

Delignification can occur by one or more processes known in the art. The lignin can be removed using the Kraft pulping process. The Kraft process uses both sodium hyrdoxide and sodium sulfide as delignifying agents. As the wood pulp is heated, the sodium sulfide is hydrolyzed and the different sulfur compounds react with lignin to form more soluable thiolignins. Delignification can occur by the use of soda pupling (i.e., the use of sodium hydroxide in the pulping liquor). Likewise, delignification processes can make use of quinonic compounds, such as anthraquinone.

In one embodiment, the methods of the invention can be used to decrease the lignin content of wood pulp. As used herein, a "kappa number" refers to a measure of the residual lignin in wood pulp. The kappa number can be obtained by measuring the comsumption of permanganate ions that react with lignin in the pulp. Accordingly, lower kappa numbers are associated with lower levels of lignin content in wood pulp. In other embodiment, the methods of the invention can be used to increase the lignin content of wood pulp.

In other embodiments, the methods of the invention can be used to decrease the Klason lignin content of wood and wood pulp. See M. J. Effland, *T.A.P.P.I.* 60:143-144 (1977). In another embodiment, the methods of the invention can be used to increase the Klason lignin content of wood and wood pulp.

III. Expression Profiling of Monolignol Synthesis, Monolignol Transportation, and Lignin Polymerization The present invention also provides methods and tools for performing expression profiling of monolignol synthesis, monolignol transportation, and lignin polymerization genes. Expression profiling is useful in determining whether genes are transcribed or translated, comparing transcript levels for particular genes in different tissues, genotyping, estimating DNA copy number, determining identity of descent, measuring mRNA decay rates, identifying protein binding sites, determining subcellular localization of gene products, correlating gene expression to a phenotype or other phenomenon, and determining the effect on other genes of the manipulation of a particular gene. Expression profiling is particularly useful for identifying gene expression in complex, multigenic events, such as the lignification process. For this reason, expression profiling is useful in correlating monolignol synthesis, monolignol transportation, and lignin polymerization gene expression to plant phenotype and formation of plant tissues and the interconnection thereof to the lignification process.

Only a small fraction of a plant's monolignol synthesis, monolignol transportation, and lignin polymerization genes are expressed at a given time in a given tissue sample, and all of the expressed genes may not affect the plant phenotype. To identify genes capable of affecting a phenotype of interest, the present invention provides methods and tools for determining, for example, a monolignol synthesis, monolignol transportation, and lignin polymerization gene expression profile at a given point in plant development and a monolignol synthesis, monolignol transportation, and lignin polymerization gene expression profile a given tissue sample. The invention also provides methods and tools for identifying monolignol synthesis, monolignol transportation, and lignin polymerization genes whose expression can be manipulated to alter plant phenotype. In support of these methods, the invention also provides methods and tools that distinguish expression of different genes of the same family, such as methyltransferases and peroxidases.

As used herein, "gene expression" refers to the process of transcription of a DNA sequence into an RNA sequence, followed by translation of the RNA into a protein, which may or may not undergo post-translational processing. Thus, the relationship between plant phenotype and monolignol synthesis, monolignol transportation, and lignin polymerization gene expression can be observed by detecting, quantitatively or qualitatively, changes in the level of an RNA or a protein. As used herein, the term "biological activity" includes, but is not limited to, the activity of a protein gene product, including enzyme activity, such as, for example, methyltransferase activity.

The present invention provides oligonucleotides that are useful in these expression profiling methods. Each oligonucleotide is capable of hybridizing under a given set of conditions to a monolignol synthesis, monolignol transport, or lignin polymerization gene or gene product. In one aspect of the invention, a plurality of oligonucleotides is provided, wherein each oligonucleotide hybridizes under a given set of conditions to a different monolignol synthesis, monolignol transport, or lignin polymerization gene product. Examples of oligonucleotides of the present invention include SEQ ID NOs: 505-756, 767 and 770. Each of the oligonucleotides of SEQ ID NOs 505-756, 767 and 770 hybridizes under standard conditions to a different gene product of one of SEQ ID NOs: 1-252, 765 and 768. The oligonucleotides of the invention are useful in determining the expression of one or more monolignol synthesis, monolignol transport, or lignin polymerization genes in any of the above-described methods.

A. Cell, Tissue, Nucleic Acid and Protein Samples

Samples for use in methods of the present invention may be derived from plant tissue. Suitable plant tissues include, but are not limited to, somatic embryos, pollen, leaves, stems, calli, stolons, microtubers, shoots, xylem, male strolbili, female strolbili, pollen cones, vascular tissue, apical meristem, vascular cambium, xylem, root, flower, and seed.

According to the present invention "plant tissue" is used as described previously herein. Plant tissue can be obtained from any of the plants types or species described supra.

In accordance with one aspect of the invention, samples can be obtained from plant tissue at different developmental stages, from plant tissue at various times of the year (e.g. spring versus summer), from plant tissues subject to different environmental conditions (e.g. variations in light and temperature) and/or from different types of plant tissue and cells. In accordance with one embodiment, plant tissue is obtained during various stages of maturity and during different seasons of the year. In a further embodiment, plant tissue is obtained from plants displaying different phenotypes. For example, plant tissue can be collected from stem dividing cells, differentiating xylem, early developing wood cells, differentiated early wood cells, and differentiated late wood cells. As another example, gene expression in a sample obtained from a plant with developing wood can be compared to gene expression in a sample obtained from a plant which does not have developing wood. As a further example, gene expression in a sample obtained from a plant displaying a reaction wood phenotype, such as compression wood or tension wood, can be compared to gene expression in a sample obtained from a plant which does not have reaction wood.

Differentiating xylem includes samples obtained from reaction wood. Reaction wood includes compression wood, side-wood, tension wood, and normal vertical xylem. Methods of obtaining samples for expression profiling from pine and eucalyptus are known. See, e.g., Allona et al., *Proc. Nat'l Acad. Sci.* 95:9693-8 (1998) and Whetton et al., *Plant Mol. Biol.* 47:275-91, and Kirst et al., Int'l Union of Forestry Research Organizations Biennial Conference, S6.8 (June 2003, Umea, Sweden).

In one embodiment of the invention, gene expression in one type of tissue is compared to gene expression in a different type of tissue or to gene expression in the same type of tissue in a difference stage of development. Gene expression can also be compared in one type of tissue which is sampled at various times during the year (different seasons). For example, gene expression in juvenile secondary xylem can be compared to gene expression in mature secondary xylem. Similarly, gene expression in cambium can be compared to gene expression in xylem. Furthermore, gene expression in apical meristems can be compared to gene expression in cambium.

In another embodiment of the invention, a sample is obtained from a plant having a specific phenotype and gene expression in that sample is compared to a sample obtained from a plant of the same species that does not have that phenotype. For example, a sample can be obtained from a plant exhibiting a fast rate of growth and gene expression can be compared with that of a sample obtained from a plant exhibiting a normal or slow rate of growth. Differentially expressed genes identified from such a comparison can be correlated with growth rate and, therefore, useful for manipulating growth rate.

In a further embodiment, a sample is obtained from clonally propagated plants. In one embodiment the clonally propagated plants are of the species *Pinus* or *Eucalyptus*. Individual ramets from the same genotype can be sacrificed at different times of year. Thus, for any genotype there can be at least two genetically identical trees sacrificed, early in the season and late in the season. Each of these trees can be divided into juvenile (top) to mature (bottom) samples. Further, tissue samples can be divided into, for example, phloem to xylem, in at least 5 layers of peeling. Each of these samples can be evaluated for phenotype and gene expression.

Where cellular components may interfere with an analytical technique, such as a hybridization assay, enzyme assay, a ligand binding assay, or a biological activity assay, it may be desirable to isolate the gene products from such cellular components. Gene products, including nucleic acid and amino acid gene products, can be isolated from cell fragments or lysates by any method known in the art.

Nucleic acids used in accordance with the invention can be prepared by any available method or process, or by other processes as they become known in the art. Conventional techniques for isolating nucleic acids are detailed, for example, in Tijssen, LABORATORY TECHNIQUES IN BIOCHEMISTRY AND MOLECULAR BIOLOGY, Hybridization With Nucleic Acid Probes, chapter 3 (Elsevier Press, 1993), Berger and Kimmel, *Methods Enzymol.* 152:1 (1987), and Gibco BRL & Life Technologies Trizol RNA Isolation Protocol, Form No. 3786 (2000). Techniques for preparing nucleic acid samples, and sequencing polynucleotides from pine and eucalyptus are known. See, e.g., Allona et al., supra and Whetton et al., supra.

A suitable nucleic acid sample can contain any type of nucleic acid derived from the transcript of a monolignol synthesis, monolignol transport, or lignin polymerization gene, i.e., RNA or a subsequence thereof or a nucleic acid for which an mRNA transcribed from a monolignol synthesis, monolignol transport, or lignin polymerization gene served as a template. Suitable nucleic acids include cDNA reverse-transcribed from a transcript, RNA transcribed from that cDNA, DNA amplified from the cDNA, and RNA transcribed from the amplified DNA. Detection of such products or derived products is indicative of the presence and/or abundance of the transcript in the sample. Thus, suitable samples include, but are not limited to, transcripts of the gene or genes, cDNA reverse-transcribed from the transcript, cRNA transcribed from the cDNA, DNA amplified from the genes, and RNA transcribed from amplified DNA. As used herein, the category of "transcripts" includes but is not limited to pre-mRNA nascent transcripts, transcript processing intermediates, and mature mRNAs and degradation products thereof.

It is not necessary to monitor all types of transcripts to practice the invention. For example, the expression profiling methods of the invention can be conducted by detecting only one type of transcript, such as mature mRNA levels only.

In one aspect of the invention, a chromosomal DNA or cDNA library (comprising, for example, fluorescently labeled cDNA synthesized from total cell mRNA) is prepared for use in hybridization methods according to recognized methods in the art. See Sambrook et al., supra.

In another aspect of the invention, mRNA is amplified using, e.g., the MessageAmp kit (Ambion). In a further aspect, the mRNA is labeled with a detectable label. For example, mRNA can be labeled with a fluorescent chromophore, such as CyDye (Amersham Biosciences).

In some applications, it may be desirable to inhibit or destroy RNase that often is present in homogenates or lysates, before use in hybridization techniques. Methods of inhibiting or destroying nucleases are well known. In one embodiment of the invention, cells or tissues are homogenized in the presence of chaotropic agents to inhibit nuclease. In another embodiment, RNase is inhibited or destroyed by heat treatment, followed by proteinase treatment.

Protein samples can be obtained by any means known in the art. Protein samples useful in the methods of the invention include crude cell lysates and crude tissue homogenates. Alternatively, protein samples can be purified. Various methods of protein purification well known in the art can be found in Marshak et al., STRATEGIES FOR PROTEIN PURIFICATION AND CHARACTERIZATION: A LABORATORY COURSE MANUAL (Cold Spring Harbor Laboratory Press 1996).

B. Detecting Levels of Gene Expression

For methods of the invention that comprise detecting a level of gene expression, any method for observing gene expression can be used, without limitation. Such methods include traditional nucleic acid hybridization techniques, polymerase chain reaction (PCR) based methods, and protein determination. The invention includes detection methods that use solid support-based assay formats as well as those that use solution-based assay formats.

Absolute measurements of the expression levels need not be made, although they can be made. The invention includes methods comprising comparisons of differences in expression levels between samples. Comparison of expression levels can be done visually or manually, or can be automated and done by a machine, using for example optical detection means. Subrahmanyam et al., *Blood.* 97: 2457 (2001); Prashar et al., *Methods Enzymol.* 303: 258 (1999). Hardware and software for analyzing differential expression of genes are available, and can be used in practicing the present invention. See, e.g., GenStat Software and GeneExpress® GX Explorer™ Training Manual, supra; Baxevanis & Francis-Ouellette, supra.

In accordance with one embodiment of the invention, nucleic acid hybridization techniques are used to observe gene expression. Exemplary hybridization techniques include Northern blotting, Southern blotting, solution hybridization, and S1 nuclease protection assays.

Nucleic acid hybridization typically involves contacting an oligonucleotide probe and a sample comprising nucleic acids under conditions where the probe can form stable hybrid duplexes with its complementary nucleic acid through complementary base pairing. For example, see PCT application WO 99/32660; Berger & Kimmel, *Methods Enzymol.* 152: 1 (1987). The nucleic acids that do not form hybrid duplexes are then washed away leaving the hybridized nucleic acids to be detected, typically through detection of an attached detectable label. The detectable label can be present on the probe, or on the nucleic acid sample. In one embodiment, the nucleic acids of the sample are detectably labeled polynucleotides representing the mRNA transcripts present in a plant tissue (e.g., a cDNA library). Detectable labels are commonly radioactive or fluorescent labels, but any label capable of detection can be used. Labels can be incorporated by several approached described, for instance, in WO 99/32660, supra. In one aspect RNA can be amplified using the MessageAmp kit (Ambion) with the addition of aminoallyl-UTP as well as free UTP. The aminoallyl groups incorporated into the amplified RNA can be reacted with a fluorescent chromophore, such as CyDye (Amersham Biosciences)

Duplexes of nucleic acids are destabilized by increasing the temperature or decreasing the salt concentration of the buffer containing the nucleic acids. Under low stringency conditions (e.g., low temperature and/or high salt) hybrid duplexes (e.g., DNA:DNA, RNA:RNA or RNA:DNA) will form even where the annealed sequences are not perfectly complementary. Thus, specificity of hybridization is reduced at lower stringency. Conversely, at higher stringency (e.g., higher temperature and/or lower salt and/or in the presence of destabilizing reagents) hybridization tolerates fewer mismatches.

Typically, stringent conditions for short probes (e.g., 10 to 50 nucleotide bases) will be those in which the salt concentration is at least about 0.01 to 1.0 M at pH 7.0 to 8.3 and the temperature is at least about 30° C. Stringent conditions can also be achieved with the addition of destabilizing agents such as formamide.

Under some circumstances, it can be desirable to perform hybridization at conditions of low stringency, e.g., 6×SSPE-T (0.9 M NaCl, 60 mM $NaH_2PO_4$, pH 7.6, 6 mM EDTA, 0.005% Triton) at 37° C., to ensure hybridization. Subsequent washes can then be performed at higher stringency (e.g., 1×SSPE-T at 37° C.) to eliminate mismatched hybrid duplexes. Successive washes can be performed at increasingly higher stringency (e.g., down to as low as 0.25×SSPE-T at 37° C. to 50° C.) until a desired level of hybridization specificity is obtained.

In general, standard conditions for hybridization is a compromise between stringency (hybridization specificity) and signal intensity. Thus, in one embodiment of the invention, the hybridized nucleic acids are washed at successively higher stringency conditions and read between each wash. Analysis of the data sets produced in this manner will reveal a wash stringency above which the hybridization pattern is not appreciably altered and which provides adequate signal for the particular oligonucleotide probes of interest. For example, the final wash may be selected as that of the highest stringency that produces consistent results and that provides a signal intensity greater than approximately 10% of the background intensity.

1. Oligonucleotide Probes

Oligonucleotide probes useful in nucleic acid hybridization techniques employed in the present invention are capable of binding to a nucleic acid of complementary sequence through one or more types of chemical bonds, usually through complementary base pairing via hydrogen bond formation. A probe can include natural bases (i.e., A, G, U, C or T) or modified bases (7-deazaguanosine, inosine, etc.). In addition, the nucleotide bases in the probes can be joined by a linkage other than a phosphodiester bond, so long as it does not interfere with hybridization. Thus, probes can be peptide nucleic acids in which the constituent bases are joined by peptide bonds rather than phosphodiester linkages.

Oligonucleotide probes can be prepared by any means known in the art. Probes useful in the present invention are capable of hybridizing to a nucleotide product of a monolignol synthesis, monolignol transport, or lignin polymerization gene, such as one of SEQ ID NOs: 1-252, 765 and 768. Probes useful in the invention can be generated using the nucleotide sequences disclosed in SEQ ID NOs: 1-252, 765 and 768. The invention includes oligonucleotide probes having at least a 2, 10, 15, 20, 30, 35, 40, 45, 50, 55, 60, 65, 70, 75, 80, 85, or 100 nucleotide fragment of a corresponding contiguous sequence of any one of SEQ ID NOs: 1-252, 765 and 768. The invention includes oligonucleotides of less than 2, 1, 0.5, 0.1, or 0.05 kb in length. In one embodiment, the oligonucleotide is 60 nucleotides in length. In another embodiment, the oligonucleotide is 30 nucleotides in length.

Oligonucleotide probes can be designed by any means known in the art. See, e.g., Li and Stormo, *Bioinformatics* 17: 1067-76 (2001). Oligonucleotide probe design can be effected using software. Exemplary software includes ArrayDesigner, GeneScan, and ProbeSelect. Probes complementary to a defined nucleic acid sequence can be synthesized chemically, generated from longer nucleotides using restriction enzymes, or can be obtained using techniques such as polymerase chain reaction (PCR). PCR methods are well known and are described, for example, in Innis et al. eds., PCR PROTOCOLS: A GUIDE TO METHODS AND APPLICATIONS, Academic Press Inc. San Diego, Calif. (1990). The probes can be labeled, for example, with a radioactive, biotinylated, or fluorescent tag. Optimally, the nucleic acids in the sample are labeled and the probes are not labeled. Oligonucleotide probes generated by the above methods can be used in solution or solid support-based methods.

The invention includes oligonucleotide probes that hybridize to a product of the coding region or a 3' untranslated region (3' UTR) of a monolignol synthesis, monolignol transport, or lignin polymerization gene. In one embodiment, the oligonucleotide probe hybridizes to the 3'UTR of any one of SEQ ID NOs: 1-29. The 3' UTR is generally a unique region of the gene, even among members of the same family. Therefore, the probes capable of hybridizing to a product of the 3' UTR can be useful for differentiating the expression of individual genes within a family where the coding region of the genes likely are highly homologous. This allows for the design of oligonucleotide probes to be used as members of a plurality of oligonucleotides, each capable of uniquely binding to a single gene. In another embodiment, the oligonucleotide probe comprises any one of SEQ ID NOs: 505-756, 767 and 770. In another embodiment, the oligonucleotide probe consists of any one of SEQ ID NOs: 1-252, 765 and 768.

2. Oligonucleotide Array Methods

One embodiment of the invention employs two or more oligonucleotide probes in combination to detect a level of expression of one or more monolignol synthesis, monolignol transport, and lignin polymerization genes, such as the genes of SEQ ID NOs: 1-252, 765 and 768. In one aspect of this embodiment, the level of expression of two or more different genes is detected. The two or more genes may be from the same or different monolignol synthesis, monolignol transport, and lignin polymerization gene families discussed above. Each of the two or more oligonucleotides may hybridize to a different one of the genes.

One embodiment of the invention employs two or more oligonucleotide probes, each of which specifically hybridize to a polynucleotide derived from the transcript of a gene provided by SEQ ID NOs: 1-252, 765 and 768. Another embodiment employs two or more oligonucleotide probes, at least one of which comprises a nucleic acid sequence of SEQ ID NOs: 505-756, 767 and 770. Another embodiment employs two or more oligonucleotide probes, at least one of which consists of SEQ ID NOs: 505-756, 767 and 770.

The oligonucleotide probes may comprise from about 5 to about 60, or from about 5 to about 500, nucleotide bases, such as from about 60 to about 100 nucleotide bases, including from about 15 to about 60 nucleotide bases.

One embodiment of the invention uses solid support-based oligonucleotide hybridization methods to detect gene expression. Solid support-based methods suitable for practicing the present invention are widely known and are described, for example, in PCT application WO 95/11755; Huber et al., *Anal. Biochem.* 299: 24 (2001); Meiyanto et al., *Biotechniques.* 31: 406 (2001); Relogio et al., *Nucleic Acids Res.* 30:e51 (2002). Any solid surface to which oligonucleotides can be bound, covalently or non-covalently, can be used. Such solid supports include filters, polyvinyl chloride dishes, silicon or glass based chips, etc.

One embodiment uses oligonucleotide arrays, i.e. microarrays, which can be used to simultaneously observe the expression of a number of genes or gene products. Oligonucleotide arrays comprise two or more oligonucleotide probes provided on a solid support, wherein each probe occupies a unique location on the support. The location of each probe may be predetermined, such that detection of a detectable signal at a given location is indicative of hybridization to an oligonucleotide probe of a known identity. Each predetermined location can contain more than one molecule of a probe, but each molecule within the predetermined location has an identical sequence. Such predetermined locations are termed features. There can be, for example, from 2, 10, 100, 1,000, 2,000 or 5,000 or more of such features on a single solid support. In one embodiment, each oligonucleotide is located at a unique position on an array at least 2, at least 3, at least 4, at least 5, at least 6, or at least 10 times.

Oligonucleotide probe arrays for detecting gene expression can be made and used according to conventional techniques described, for example, in Lockhart et al., Nat'l Biotech. 14: 1675 (1996), McGall et al., *Proc. Nat'l Acad. Sci. USA* 93: 13555 (1996), and Hughes et al., *Nature Biotechnol.*

19:342 (2001). A variety of oligonucleotide array designs is suitable for the practice of this invention.

In one embodiment the one or more oligonucleotides include a plurality of oligonucleotides that each hybridize to a different gene expressed in a particular tissue type. For example, the tissue can be developing wood.

In one embodiment, a nucleic acid sample obtained from a plant can be amplified and, optionally labeled with a detectable label. Any method of nucleic acid amplification and any detectable label suitable for such purpose can be used. For example, amplification reactions can be performed using, e.g. Ambion's MessageAmp, which creates "antisense" RNA or "aRNA" (complementary in nucleic acid sequence to the RNA extracted from the sample tissue). The RNA can optionally be labeled using CyDye fluorescent labels. During the amplification step, aaUTP is incorporated into the resulting aRNA. The CyDye fluorescent labels are coupled to the aaUTPs in a non-enzymatic reaction. Subsequent to the amplification and labeling steps, labeled amplified antisense RNAs are precipitated and washed with appropriate buffer, and then assayed for purity. For example, purity can be assay using a NanoDrop spectrophotometer. The nucleic acid sample is then contacted with an oligonucleotide array having, attached to a solid substrate (a "microarray slide"), oligonucleotide sample probes capable of hybridizing to nucleic acids of interest which may be present in the sample. The step of contacting is performed under conditions where hybridization can occur between the nucleic acids of interest and the oligonucleotide probes present on the array. The array is then washed to remove non-specifically bound nucleic acids and the signals from the labeled molecules that remain hybridized to oligonucleotide probes on the solid substrate are detected. The step of detection can be accomplished using any method appropriate to the type of label used. For example, the step of detecting can accomplished using a laser scanner and detector. For example, on can use and Axon scanner which optionally uses GenePix Pro software to analyze the position of the signal on the microarray slide.

Data from one or more microarray slides can analyzed by any appropriate method known in the art.

Oligonucleotide probes used in the methods of the present invention, including microarray techniques, can be generated using PCR. PCR primers used in generating the probes are chosen, for example, based on the sequences of SEQ ID NOs: 1-252, 765 and 768, to result in amplification of unique fragments of the monolignol synthesis, monolignol transport, and lignin polymerization genes (i.e., fragments that hybridize to only one polynucleotide of any one of SEQ ID NOs: 1-252, 765 and 768 under standard hybridization conditions). Computer programs are useful in the design of primers with the required specificity and optimal hybridization properties. For example, Li and Stormo, supra, discuss a method of probe selection using ProbeSelect which selects an optimum oligonucleotide probe based on the entire gene sequence as well as other gene sequences to be probed at the same time.

In one embodiment, oligonucleotide control probes also are used. Exemplary control probes can fall into at least one of three categories referred to herein as (1) normalization controls, (2) expression level controls and (3) negative controls. In microarray methods, one or more of these control probes may be provided on the array with the inventive monolignol synthesis, monolignol transport, or lignin polymerization gene-related oligonucleotides.

Normalization controls correct for dye biases, tissue biases, dust, slide irregularities, malformed slide spots, etc. Normalization controls are oligonucleotide or other nucleic acid probes that are complementary to labeled reference oligonucleotides or other nucleic acid sequences that are added to the nucleic acid sample to be screened. The signals obtained from the normalization controls, after hybridization, provide a control for variations in hybridization conditions, label intensity, reading efficiency and other factors that can cause the signal of a perfect hybridization to vary between arrays. In one embodiment, signals (e.g., fluorescence intensity or radioactivity) read from all other probes used in the method are divided by the signal from the control probes, thereby normalizing the measurements.

Virtually any probe can serve as a normalization control. Hybridization efficiency varies, however, with base composition and probe length. Preferred normalization probes are selected to reflect the average length of the other probes being used, but they also can be selected to cover a range of lengths. Further, the normalization control(s) can be selected to reflect the average base composition of the other probes being used. In one embodiment, only one or a few normalization probes are used, and they are selected such that they hybridize well (i.e., without forming secondary structures) and do not match any test probes. In one embodiment, the normalization controls are mammalian genes.

Expression level control probes hybridize specifically with constitutively expressed genes present in the biological sample. Virtually any constitutively expressed gene provides a suitable target for expression level control probes. Typically, expression level control probes have sequences complementary to subsequences of constitutively expressed "housekeeping genes" including, but not limited to certain photosynthesis genes.

As used herein, "negative control" probes are not complementary to any of the test oligonucleotides (i.e., the inventive monolignol synthesis, monolignol transport, and lignin polymerization gene-related oligonucleotides), normalization controls, or expression controls. In one embodiment, the negative control is a mammalian gene which is not complementary to any other sequence in the sample.

The terms "background" and "background signal intensity" refer to hybridization signals resulting from non-specific binding or other interactions between the labeled target nucleic acids (i.e., mRNA present in the biological sample) and components of the oligonucleotide array. Background signals also can be produced by intrinsic fluorescence of the array components themselves.

A single background signal can be calculated for the entire array, or a different background signal can be calculated for each target nucleic acid. In a one embodiment, background is calculated as the average hybridization signal intensity for the lowest 5 to 10 percent of the oligonucleotide probes being used, or, where a different background signal is calculated for each target gene, for the lowest 5 to 10 percent of the probes for each gene. Where the oligonucleotide probes corresponding to a particular monolignol synthesis, monolignol transport, and lignin polymerization gene hybridize well and, hence, appear to bind specifically to a target sequence, they should not be used in a background signal calculation. Alternatively, background can be calculated as the average hybridization signal intensity produced by hybridization to probes that are not complementary to any sequence found in the sample (e.g., probes directed to nucleic acids of the opposite sense or to genes not found in the sample). In microarray methods, background can be calculated as the average signal intensity produced by regions of the array that lack any oligonucleotides probes at all.

3. PCR-Based Methods

In another embodiment, PCR-based methods are used to detect gene expression. These methods include reverse-transcriptase-mediated polymerase chain reaction (RT-PCR) including real-time and endpoint quantitative reverse-transcriptase-mediated polymerase chain reaction (Q-RTPCR). These methods are well known in the art. For example, methods of quantitative PCR can be carried out using kits and methods that are commercially available from, for example, Applied BioSystems and Stratagene®. See also Kochanowski, QUANTITATIVE PCR PROTOCOLS (Humana Press, 1999); Innis et al., supra.; Vandesompele et al., *Genome Biol.* 3: RESEARCH0034 (2002); Stein, *Cell Mol. Life Sci.* 59: 1235 (2002).

Gene expression can also be observed in solution using Q-RTPCR. Q-RTPCR relies on detection of a fluorescent signal produced proportionally during amplification of a PCR product. See Innis et al., supra. Like the traditional PCR method, this technique employs PCR oligonucleotide primers, typically 15-30 bases long, that hybridize to opposite strands and regions flanking the DNA region of interest. Additionally, a probe (e.g., TaqMan®, Applied Biosystems) is designed to hybridize to the target sequence between the forward and reverse primers traditionally used in the PCR technique. The probe is labeled at the 5' end with a reporter fluorophore, such as 6-carboxyfluorescein (6-FAM) and a quencher fluorophore like 6-carboxy-tetramethyl-rhodamine (TAMRA). As long as the probe is intact, fluorescent energy transfer occurs which results in the absorbance of the fluorescence emission of the reporter fluorophore by the quenching fluorophore. As Taq polymerase extends the primer, however, the intrinsic 5' to 3' nuclease activity of Taq degrades the probe, releasing the reporter fluorophore. The increase in the fluorescence signal detected during the amplification cycle is proportional to the amount of product generated in each cycle.

The forward and reverse amplification primers and internal hybridization probe is designed to hybridize specifically and uniquely with one nucleotide derived from the transcript of a target gene. In one embodiment, the selection criteria for primer and probe sequences incorporates constraints regarding nucleotide content and size to accommodate TaqMan® requirements.

SYBR Green® can be used as a probe-less Q-RTPCR alternative to the Taqman®-type assay, discussed above. ABI Prism® 7900 Sequence Detection System User Guide Applied Biosystems, chap. 1-8, App. A-F. (2002).

A device measures changes in fluorescence emission intensity during PCR amplification. The measurement is done in "real time," that is, as the amplification product accumulates in the reaction. Other methods can be used to measure changes in fluorescence resulting from probe digestion. For example, fluorescence polarization can distinguish between large and small molecules based on molecular tumbling (see, e.g., U.S. Pat. No. 5,593,867).

4. Protein Detection Methods

Proteins can be observed by any means known in the art, including immunological methods, enzyme assays and protein array/proteomics techniques.

Measurement of the translational state can be performed according to several protein methods. For example, whole genome monitoring of protein—the "proteome"—can be carried out by constructing a microarray in which binding sites comprise immobilized, preferably monoclonal, antibodies specific to a plurality of proteins having an amino acid sequence of any of SEQ ID NOs: 253-504, 766 and 769 or proteins encoded by the genes of SEQ ID NOs: 1-252, 765 and 768 or conservative variants thereof. See Wildt et al., *Nature Biotechnol.* 18: 989 (2000). Methods for making polyclonal and monoclonal antibodies are well known, as described, for instance, in Harlow & Lane, ANTIBODIES: A LABORATORY MANUAL (Cold Spring Harbor Laboratory Press, 1988).

Alternatively, proteins can be separated by two-dimensional gel electrophoresis systems. Two-dimensional gel electrophoresis is well-known in the art and typically involves isoelectric focusing along a first dimension followed by SDS-PAGE electrophoresis along a second dimension. See, e.g., Hames et al, GEL ELECTROPHORESIS OF PROTEINS: A PRACTICAL APPROACH (IRL Press, 1990). The resulting electropherograms can be analyzed by numerous techniques, including mass spectrometric techniques, western blotting and immunoblot analysis using polyclonal and monoclonal antibodies, and internal and N-terminal micro-sequencing.

C. Correlating Gene Expression to Phenotype and Tissue Development

As discussed above, the invention provides methods and tools to correlate gene expression to plant phenotype. Gene expression may be examined in a plant having a phenotype of interest and compared to a plant that does not have the phenotype or has a different phenotype. Such a phenotype includes, but is not limited to, increased drought tolerance, herbicide resistance, reduced or increased height, reduced or increased branching, enhanced cold and frost tolerance, improved vigor, enhanced color, enhanced health and nutritional characteristics, improved storage, enhanced yield, enhanced salt tolerance, enhanced resistance of the wood to decay, enhanced resistance to fungal diseases, altered attractiveness to insect pests, increased disease tolerance, increased insect tolerance, increased water-stress tolerance, improved texture, increased germination, increased micronutrient uptake, production of novel resins, increased or decreased cellulose content, increased or decreased lignin content, increased or decreased nonlignin cell wall phenolics and production of novel proteins or peptides.

In another embodiment, the phenotype includes one or more of the following traits: propensity to form reaction wood, a reduced period of juvenility, an increased period of juvenility, self-abscising branches, accelerated reproductive development or delayed reproductive development.

In a further embodiment, the phenotype that is differs in the plants compares includes one or more of the following: lignin quality, lignin structure, wood composition, wood appearance, wood density, wood strength, wood stiffness, cellulose polymerization, fiber dimensions, lumen size, proportion of rays, proportion of vessel elements, other plant components, plant cell division, plant cell development, number of cells per unit area, cell size, cell shape, cell wall composition, proportion of nonlignin cell wall phenolics, rate of wood formation, aesthetic appearance of wood, formation of stem defects, average microfibril angle, width of the S2 cell wall layer, rate of growth, rate of root formation ratio of root to branch vegetative development, leaf area index, and leaf shape. Phenotype can be assessed by any suitable means as discussed above, such as, for example Hertzberg, supra, Ye and Sundström, supra, U.S. Patent Application Publication Nos. 2002/0107644 and 2002/0113212, Marita et al., supra.

It will be apparent to those skilled in the art that various modifications and variations can be made in the methods and compositions of the present invention without departing from the spirit or scope of the invention. Thus, it is intended that the present invention cover the modifications and variations of this invention provided they come within the scope of the appended claims and their equivalents.

The following examples are given to illustrate the present invention. It should be understood, however, that the invention is not to be limited to the specific conditions or details described in these examples. Throughout the specification, any and all references to a publicly available document, including a U.S. patent, are specifically incorporated by reference in their entirety.

EXAMPLES

Example 1

Example 1 demonstrates how monolignol synthesis, monolignol transport, and lignin polymerization and monolignol synthesis, monolignol transport, and lignin polymerization-like genes are isolated and characterized in *E. grandis* and *P. radiata*.

Total RNA was extracted from plant tissue (using the protocol of Chang et al., *Plant Mol. Biol. Rep.* 11:113-116 (1993). Plant tissue samples were obtained from phloem (P), cambium (C), expanding xylem (X1), and differentiating and lignifying xylem (X2).

mRNA was isolated from the total RNA preparation using either a Poly(A) Quik mRNA Isolation Kit (Stratagene, La Jolla, Calif.) or Dynal Beads Oligo $(dT)_{25}$ (Dynal, Skogen, Norway). cDNA expression libraries were constructed from the purified mRNA by reverse transcriptase synthesis followed by insertion of the resulting cDNA clones in Lambda ZAP using a ZAP Express cDNA Synthesis Kit (Stratagene), according to the using the manufacturer's protocol. The resulting cDNAs were packaged using a Gigapack II Packaging Extract (Stratagene) using an aliquot (1-5 µL) from the 5 µL ligation reaction dependent upon the library. Mass excision of the library was done using XL1-Blue MRF' cells and XLOLR cells (Stratagene) with ExAssist helper phage (Stratagene). The excised phagemids were diluted with NZY broth (Gibco BRL, Gaithersburg, Md.) and plated out onto LB-kanamycin agar plates containing X-gal and isopropylthio-beta-galactoside (IPTG).

Of the colonies plated and selected for DNA miniprep, 99% contained an insert suitable for sequencing. Positive colonies were cultured in NZY broth with kanamycin and cDNA was purified by means of alkaline lysis and polyethylene glycol (PEG) precipitation. Agarose gel at 1% was used to screen sequencing templates for chromosomal contamination. Dye primer sequences were prepared using a Turbo Catalyst 800 machine (Perkin Elmer/Applied Biosystems Division, Foster City, Calif.) according to the manufacturer's protocol.

DNA sequence for positive clones was obtained using a Perkin Elmer/Applied Biosystems Division Prism 377 sequencer. cDNA clones were sequenced first from the 5' end and, in some cases, also from the 3' end. For some clones, internal sequence was obtained using either Exonuclease III deletion analysis, yielding a library of differentially sized subclones in pBK-CMV, or by direct sequencing using gene-specific primers designed to identify regions of the gene of interest. The determined cDNA sequences are provided in SEQ ID NOS: 1-252, 765 and 768. The predicted polypeptide sequences are SEQ ID NOs: 253-504, 766 and 769.

To identify monolignol synthesis, monolignol transport, and lignin polymerization gene candidates in *P. radiata* and *E. grandis* databases, the cDNA sequences were compared to public domain sequences (by SWISS-PROT/TrEMBL ID's) to search against the pine and eucalyptus databases (non-redundant by contig, expect<$1.0e^{-2}$).

The contig consensus DNA and protein sequences were then obtained for these hits, and duplicate sequences were identified. A multiple alignment was then carried out with the protein sequences. The protein alignment was created using the remaining pine and eucalyptus sequences along with the *Arabidopsis* members. From the protein alignment, a dendogram was created. These sequences were analyzed by primer walking to provide a full length sequence (best HT pick from the contig analyzed for full length sequence).

The public domain monolignol synthesis, monolignol transport, and lignin polymerization gene sequences from maize, cotton, rice, and poplar were also extracted and blasted against the pine and eucalyptus databases. The completed primer walked pine and eucalyptus sequences were also blasted against ownseq and the top 500 hits were taken. This was done so that the sequences could be used to search further and ensure that nothing in the pine and eucalyptus databases had been missed by using the *Arabidopsis* superfamily. This search resulted in an additional 4 sequences which were not found in the previous searches. These sequences were then also sent for primer walked full length sequence.

After removing a small number of additional duplicates after primer walking, pine and eucalyptus primer walked monolignol synthesis, monolignol transport, and lignin polymerization superfamily members were identified. The classification of these sequences was confirmed by alignment with ClustalX, the corresponding dendogram, and MEME/MAST analysis.

Example 2

To identify additional sequence 5' or 3' of a partial cDNA sequence in a cDNA library, 5' and 3' rapid amplification of cDNA ends (RACE) was performed. using the SMART RACE cDNA amplification kit (Clontech Laboratories, Palo Alto, Calif.). Generally, the method entailed first isolating poly(A) mRNA, performing first and second strand cDNA synthesis to generate double stranded cDNA, blunting cDNA ends, and then ligating of the SMART RACE Adaptor to the cDNA to form a library of adaptor-ligated ds cDNA. Gene-specific primers were designed to be used along with adaptor specific primers for both 5' and 3' RACE reactions. Using 5' and 3' RACE reactions, 5' and 3' RACE fragments were obtained, sequenced, and cloned. The process may be repeated until 5' and 3' ends of the full-length gene were identified. A full-length cDNA may generated by PCR using primers specific to 5' and 3' ends of the gene by end-to-end PCR.

For example, to amplify the missing 5' region of a gene from first-strand cDNA, a primer was designed 5'→3' from the opposite strand of the template sequence, and from the region between ~100-200 bp of the template sequence. A successful amplification should give an overlap of ~100 bp of DNA sequence between the 5' end of the template and PCR product.

RNA was extracted from four pine tissues, namely seedling, xylem, phloem and structural root using the Concert Reagent Protocol (Invitrogen, Carlsbad, Calif.) and standard isolation and extraction procedures. The resulting RNA was then treated with DNase, using 10 U/µl DNase I (Roche Diagnostics, Basel, Switzerland). For 100 µg of RNA, 9 µl 10× DNase buffer (Invitrogen, Carlsbad, Calif.), 10 µl of Roche DNase I and 90 µl of Rnase-free water was used. The RNA was then incubated at room temperature for 15 minutes and ¹⁄₁₀ volume 25 mM EDTA is added. A RNeasy mini kit (Qiagen, Venlo, The Netherlands) was used for RNA purification according to manufacturer's protocol.

To synthesize cDNA, the extracted RNA from xylem, phloem, seedling and root was used and the SMART RACE cDNA amplification kit (Clontech Laboratories Inc, Palo Alto, Calif.) was followed according to manufacturer's protocol. For the RACE PCR, the cDNA from the four tissue types was combined. The master mix for PCR was created by combining equal volumes of cDNA from xylem, phloem, root and seedling tissues. PCR reactions were performed in 96 well PCR plates, with 1 µl of primer from primer dilution plate (10 mM) to corresponding well positions. 49 µl of master mix is aliquoted into the PCR plate with primers. Thermal cycling commenced on a GeneAmp 9700 (Applied Biosystems, Foster City, Calif.) at the following parameters:

94° C. (5 sec),
72° C. (3 min), 5 cycles;
94° C. (5 sec),
70° C. (10 sec),
72° C. (3 min), 5 cycles;
94° C. (5 sec),
68° C. (10 sec),
72° C. (3 min), 25 cycles.

cDNA was separated on an agarose gel following standard procedures. Gel fragments were excised and eluted from the gel by using the Qiagen 96-well Gel Elution kit, following the manufacturer's instructions.

PCR products were ligated into pGEMTeasy (Promega, Madison, Wis.) in a 96 well plate overnight according to the following specifications: 60-80 ng of DNA, 5 µl 2× rapid ligation buffer, 0.5 µl pGEMT easy vector, 0.1 µl DNA ligase, filled to 10 µl with water, and incubated overnight.

Each clone was transformed into *E. coli* following standard procedures and DNA was extracted from 12 clones picked by following standard protocols. DNA extraction and the DNA quality was verified on an 1 agarose gel. The presence of the correct size insert in each of the clones was determined by restriction digests, using the restriction endonuclease EcoRI, and gel electrophoresis, following standard laboratory procedures.

Example 3

Example 3 illustrates a procedure for RNA extraction and purification, which is particularly useful for RNA obtained from conifer needle, xylem, cambium, and phloem.

Tissue is obtained from conifer needle, xylem, cambium or phloem. The tissue is frozen in liquid nitrogen and ground. The total RNA is extracted using Concert Plant RNA reagent (Invitrogen). The resulting RNA sample is extracted into phenol:chloroform and treated with DNase. The RNA is then incubated at 65° C. for 2 minutes followed by centrifugation at 4° C. for 30 minutes. Following centrifugation, the RNA is extracted into phenol at least 10 times to remove contaminants.

The RNA is further cleaned using RNeasy columns (Qiagen). The purified RNA is quantified using RiboGreen reagent (Molecular Probes) and purity assessed by gel electrophoresis.

RNA is then amplified using MessageAmp (Ambion). Aminoallyl-UTP and free UTP are added to the in vitro transcription of the purified RNA at a ratio of 4:1 aminoallyl-UTP-to-UTP. The aminoallyl-UTP is incorporated into the new RNA strand as it is transcribed. The amino-allyl group is then reacted with Cy dyes to attach the colorimetric label to the resulting amplified RNA using the Amersham procedure modified for use with RNA. Unincorporated dye is removed by ethanol precipitation. The labeled RNA is quantified spectrophotometrically (NanoDrop). The labeled RNA is fragmented by heating to 95° C. as described in Hughes et al., *Nature Biotechnol.* 19:342 (2001).

Example 4

Example 4 illustrates how monolignol synthesis, monolignol transport, and lignin polymerization genes important for wood development in *P. radiata* are determined and how oligonucleotides which uniquely bind to those genes can be designed and synthesized for use on a microarray.

Pine trees of the species *P. radiata* are grown under natural light conditions. Tissue samples are prepared as described in, e.g., Sterky et al., *Proc. Nat'l Acad. Sci.* 95:13330 (1998). Specifically, tissue samples are collected from woody trees having a height of 5 meters. Tissue samples of the woody trees are prepared by taking tangential sections through the cambial region of the stem. The stems are sectioned horizontally into sections ranging from juvenile (top) to mature (bottom). The stem sections separated by stage of development are further separated into 5 layers by peeling into sections of phloem, differentiating phloem, cambium, differentiating xylem, developing xylem, and mature xylem. Tissue samples, including leaves, buds, shoots, and roots are also prepared from seedlings of the species *P. radiata*.

RNA is isolated and ESTs generated as described in Example 1 or Sterky et al., supra. The nucleic acid sequences of ESTs derived from samples containing developing wood are compared with nucleic acid sequences of genes known to be involved in monolignol synthesis, monolignol transport, or lignin polymerization. ESTs from samples that do not contain developing wood are also compared with sequences of genes known to be involved in the plant cell cycle. An in silico hybridization analysis is performed using BLAST (NCBI). TABLES 9 and 10 show in silico hybridization data for monolignol synthesis, monolignol transporation, and lignin polymerization proteins in *P. radiata* (TABLE 9) and *E. grandis* (TABLE 10).

Sequences from among the known monolignol synthesis, monolignol transport, and lignin polymerization genes that show hybridization in silico to ESTs made from samples containing developing wood, but that do not hybridize to ESTs from samples not containing developing wood are selected for further examination.

cDNA clones containing sequences that hybridize to the genes showing wood-preferred expression are selected from cDNA libraries using techniques well known in the art of molecular biology. Using the sequence information, oligonucleotides are designed such that each oligonucleotide is specific for only one cDNA sequence in the library. The oligonucleotide sequences are provided in TABLE 4 and TABLE 8. 60-mer oligonucleotide probes are designed using the method of Li and Stormo, supra, or using software such as ArrayDesigner, GeneScan, and ProbeSelect.

The oligonucleotides are then synthesized in situ described in Hughes et al., *Nature Biotechnol.* 19:324 (2002) or as described in Kane et al., *Nucleic Acids Res.* 28:4552 (2000) and affixed to an activated glass slide (Sigma-Genosis, The Woodlands, Tex.) using a 5' amino linker. The position of each oligonucleotide on the slide is known.

Example 5

Example 5 illustrates how RNAs of tissues from multiple pine species, in this case both *P. radiata* and loblolly pine *P. taeda* trees, are selected for analysis of the pattern of gene expression associated with wood development in the juvenile wood and mature wood forming sections of the trees using the microarrays derived from *P. radiata* cDNA sequences described in Example 4.

Open pollinated trees of approximately 16 years of age are selected from plantation-grown sites, in the United States for loblolly pine, and in New Zealand for radiata pine. Trees are felled during the spring and summer seasons to compare the expression of genes associated with these different developmental stages of wood formation. Trees are felled individually and trunk sections are removed from the bottom area approximately one to two meters from the base and within one to two meters below the live crown. The section removed from the basal end of the trunk contains mature wood. The section removed from below the live crown contains juvenile wood. Samples collected during the spring season are termed earlywood or springwood, while samples collected during the summer season are considered latewood or summerwood. Larson et al., *Gen. Tech. Rep.* FPL-GTR-129. Madison, Wis.: U.S. Department of Agriculture, Forest Service, Forest Products Laboratory. p. 42.

Tissues are isolated from the trunk sections such that phloem, cambium, developing xylem, and maturing xylem are removed. These tissues are collected only from the current year's growth ring. Upon tissue removal in each case, the material is immediately plunged into liquid nitrogen to preserve the nucleic acids and other components. The bark is peeled from the section and phloem tissue removed from the inner face of the bark by scraping with a razor blade. Cambium tissue is isolated from the outer face of the peeled section by gentle scraping of the surface. Developing xylem and lignifying xylem are isolated by sequentially performing more vigorous scraping of the remaining tissue. Tissues are transferred from liquid nitrogen into containers for long term storage at −70° C. until RNA extraction and subsequent analysis is performed.

Using these techniques and the microarrays as described in Example 4, a Caffeoyl-CoA O-methyltransferase (CCoAOMT) gene (SEQ ID NO: 80), was shown to be significantly up-regulated in steady state RNA levels detected in cambium and early and later developing xylem relative to phloem.

Example 6

Example 6 illustrates procedures alternative to those used in Example 3 for RNA extraction and purification, particularly useful for RNA obtained from a variety of tissues of woody plants, and a procedure for hybridization and data analysis using the arrays described in Example 4.

RNA was isolated according to the protocol of Chang et al., *Plant Mol. Biol. Rep.* 11:113. DNA is removed using DNase I (Invitrogen, Carlsbad, Calif.) according to the manufacturer's recommendations. The integrity of the RNA samples was determined using the Agilent 2100 Bioanalyzer (Agilent Technologies, USA).

10 μg of total RNA from each tissue was reversed transcribed into cDNA using known methods.

In the case of *Pinus radiata* phloem tissue, it can be difficult to extract sufficient amounts of total RNA for normal labelling procedures. Total RNA was extracted and treated as previously described and 100 ng of total RNA is amplified using the Ovation™ Nanosample RNA Amplification system from NuGEN™ (NuGEN, CA, USA). Similar amplification kits such as those manufactured by Ambion may alternatively be used. The amplified RNA was reverse transcribed into cDNA and labelled as described above.

Hybridization and stringency washes are performed using the protocol as described in the US patent application for "Methods and Kits for Labeling and Hybridizing cDNA for Microarray Analysis" (supra) at 42 C. The arrays (slides) are scanned using a ScanArray 4000 Microarray Analysis System (GSI Lumonics, Ottawa, ON, Canada). Raw, non-normalized intensity values are generated using QUANTARRAY software (GSI Lumonics, Ottawa, ON, Canada).

A fully balanced, incomplete block experimental design (Kerr and Churchill, *Gen. Res.* 123:123 (2001)) was used in order to design an array experiment that would allow maximum statistical inferences from analyzed data.

Gene expression data was analyzed using the SAS® Microarray Solution software package (The SAS Institute, Cary, N.C., USA). Resulting data was then visualized using JMP® (The SAS Institute, Cary, N.C., USA).

Analysis done for this experiment was an ANOVA approach with mixed model specification (Wolfinger et al., *J. Comp. Biol.* 8:625-637). Two steps of linear mixed models were applied. The first one, normalization model, was applied for global normalization at slide-level. The second one, gene model, was applied for doing rigorous statistical inference on each gene. Both models are stated in Models (1) and (2).

$$\log_2(Y_{ijkls}) = \theta_{ij} + D_k + S_l + DS_{kl} + \omega_{ijkls} \quad (1)$$

$$R_{ijkls}^{(g)} = \mu_{ij}^{(g)} + D_k^{(g)} + S_l^{(g)} + DS_{kl}^{(g)} + SS_{ls}^{(g)} + \epsilon_{ijkls}^{(g)} \quad (2)$$

$Y_{ijkls}$ represents the intensity of the $s^{th}$ spot in the $l^{th}$ slide with the $k^{th}$ dye applying the $j^{th}$ treatment for the $i^{th}$ cell line. $\theta_{ij}$, $D_k$, $S_l$, and $D_{Skl}$ represent the mean effect of the jth treatment in the ith cell line, the kth dye effect, the $l^{th}$ slide random effect, and the random interaction effect of the $k^{th}$ dye in the $l^{th}$ slide. $\omega_{ijkls}$ is the stochastic error term. represent the similar roles as $\theta_{ij}$, $D_k$, $S_l$, and $D_{Skl}$ except they are specific for the $g^{th}$ gene. $R_{ijkls}^{(g)}$ represents the residual of the $g^{th}$ gene from model (1). $\mu_{ij}^{(g)}$, $D_k^{(g)}$, $S_l^{(g)}$, and $DS_{kl}^{(g)}$ represent the similar roles as $\theta_{ij}$, $D_k$, $S_l$, and $DS_{kl}$ except they are specific for the $g^{th}$ gene. $SS_{ls}^{(g)}$ represent the spot by slide random effect for the $g^{th}$ gene. $\epsilon_{ijkls}^{(g)}$ represent the stochastic error term. All random terms are assumed to be normal distributed and mutually independent within each model.

According to the analysis described above, certain cDNAs, as prepented in TABLE 11, were found to be differentially expressed. In TABLE 11, the cDNAs are listed in from greatest to least fold-change of expression in later developing xylem relative to cambium. In addition SEQ ID NO: 57, a putative p-courmarate 3-monooxygenase cDNA, was identified as being expressed in phloem tissue to a greater degree than in cambium tissue.

TABLE 11

| SEQ ID NO | Putative Gene | Comment |
|---|---|---|
| 41 | Laccase | more expression in xylem than in cambium |
| 44 | Laccase | more expression in xylem than in cambium |
| 50 | Laccase | more expression in xylem than in cambium |
| 63 | Trans-cinnamate 4-monooxygenase | appears to be expressed only in later developing xylem |
| 52 | Laccase | more expression in xylem than in cambium |
| 105 | Peroxidase | more expression in xylem than in cambium |
| 51 | Laccase | more expression in xylem than in cambium |
| 52 | Laccase | appears to be expressed only in later developing xylem |
| 10 | Cinnamoyl-CoA reductase | more expression in xylem than in cambium |
| 94 | Peroxidase | less expression in xylem than in cambium |

The involvement of these specific genes in wood development was inferred through the association of the up-regulation or down-regulation of genes to the particular stages of wood development. Both the spatial continuum of wood development across a section (phloem, cambium, developing xylem, maturing xylem) at a particular season and tree trunk position and the relationships of season and tree trunk position were considered when making associations of gene expression to the relevance in wood development.

Example 7

Example 7 demonstrates how one can correlate monolignol synthesis, monolignol transport, and lignin polymerization gene expression with agronomically important wood phenotypes such as density, stiffness, strength, distance between branches, and spiral grain.

Mature clonally propagated pine trees are selected from among the progeny of known parent trees for superior growth characteristics and resistance to important fungal diseases. The bark is removed from a tangential section and the trees are examined for average wood density in the fifth annual ring at breast height, stiffness and strength of the wood, and spiral grain. The trees are also characterized by their height, mean distance between major branches, crown size, and forking.

To obtain seedling families that are segregating for major genes that affect density, stiffness, strength, distance between branches, spiral grain and other characteristics that may be linked to any of the genes affecting these characteristics, trees lacking common parents are chosen for specific crosses on the criterion that they exhibit the widest variation from each other with respect to the density, stiffness, strength, distance between branches, and spiral grain criteria. Thus, pollen from a tree exhibiting high density, low mean distance between major branches, and high spiral grain is used to pollinate cones from the unrelated plus tree among the selections exhibiting the lowest density, highest mean distance between major branches, and lowest spiral grain. It is useful to note that "plus trees" are crossed such that pollen from a plus tree exhibiting high density are used to pollinate developing cones from another plus tree exhibiting high density, for example, and pollen from a tree exhibiting low mean distance between major branches would be used to pollinate developing cones from another plus tree exhibiting low mean distance between major branches.

Seeds are collected from these controlled pollinations and grown such that the parental identity is maintained for each seed and used for vegetative propagation such that each genotype is represented by multiple ramets. Vegetative propagation is accomplished using micropropagation, hedging, or fascicle cuttings. Some ramets of each genotype are stored while vegetative propagules of each genotype are grown to sufficient size for establishment of a field planting. The genotypes are arrayed in a replicated design and grown under field conditions where the daily temperature and rainfall are measured and recorded.

The trees are measured at various ages to determine the expression and segregation of density, stiffness, strength, distance between branches, spiral grain, and any other observable characteristics that may be linked to any of the genes affecting these characteristics. Samples are harvested for characterization of cellulose content, lignin content, cellulose microfibril angle, density, strength, stiffness, tracheid morphology, ring width, and the like. Certain genotypes are selected from the population on the basis that they exhibit extremes in density, as measured in ring 5 of an increment core, or in stiffness (modulus of elasticity) as measured by means of a nondestructive stress wave instrument. An example of such an instrument is described in Wang et al., *Experimental Techniques* 191:27-29 (2000).

Those skilled in the art of tree mensuration will recognize that any of a number of such techniques are available and suitable for making such selections. The genotypes that are selected as representing the extremes are then further selected in order to find paired samples of genotypes, one in the highest quartile and one in the lowest quartile for each trait, for which all replicate trees in the field are approximately the same size and are healthy and lack evidence of herbivory, so that health and size effects are not confounded with wood quality traits in the microarray analysis. RNA samples are then isolated from scrapings taken from these trees in early spring and late summer as described in Example 5, and assayed using an oligo microarray as described in Example 6.

Example 8

Example 8 demonstrates how responses to environmental conditions such as light and season alter plant phenotype and can be correlated to monolignol synthesis, monolignol transport, and lignin polymerization gene expression using microarrays. In particular, the changes in gene expression associated with wood density are examined.

Trees of three different clonally propagated *E. grandis* hybrid genotypes are grown on a site with a weather station that measures daily temperatures and rainfall. During the spring and subsequent summer, genetically identical ramets of the three different genotypes are first photographed with north-south orientation marks, using photography at sufficient resolution to show bark characteristics of juvenile and mature portions of the plant, and then felled. The age of the trees is determined by planting records and confirmed by a count of the annual rings. In each of these trees, mature wood is defined as the outermost rings of the tree below breast height, and juvenile wood as the innermost rings of the tree above breast height. Each tree is accordingly sectored as follows:

NM—NORTHSIDE MATURE

SM—SOUTHSIDE MATURE

NT—NORTHSIDE TRANSITION

ST—SOUTHSIDE TRANSITION

NJ—NORTHSIDE JUVENILE

SJ—SOUTHSIDE JUVENILE

Tissue is harvested from the plant trunk as well as from juvenile and mature form leaves. Samples are prepared simultaneously for phenotype analysis, including plant morphology and biochemical characteristics, and gene expression analysis. The height and diameter of the tree at the point from which each sector was taken is recorded, and a soil sample from the base of the tree is taken for chemical assay. Samples prepared for gene expression analysis are weighed and placed into liquid nitrogen for subsequent preparation of RNA samples for use in the microarray experiment. The tissues are denoted as follows:

P—phloem
C—cambium
X1—expanding xylem
X2—differentiating and lignifying xylem

Thin slices in tangential and radial sections from each of the sectors of the trunk are fixed as described in Ruzin, PLANT MICROTECHNIQUE AND MICROSCOPY, Oxford University Press, Inc., New York, N.Y. (1999) for anatomical examination and confirmation of wood developmental stage. Microfibril angle is examined at the different developmental stages of the wood, for example juvenile, transition and mature phases of *Eucalyptus* grandis wood. Other characteristics examined are the ratio of fibers to vessel elements and ray tissue in each sector. Additionally, the samples are examined for characteristics that change between juvenile and mature wood and between spring wood and summer wood, such as fiber morphology, lumen size, and width of the S2 (thickest) cell wall layer. Samples are further examined for measurements of density in the fifth ring and determination of modulus of elasticity using techniques well known to those skilled in the art of wood assays. See, e.g., Wang, et al., *Non-destructive Evaluations of Trees*, EXPERIMENTAL TECHNIQUES, pp. 28-30 (2000).

For biochemical analysis, 50 grams from each of the harvest samples are freeze-dried and analyzed, using biochemical assays well known to those skilled in the art of plant biochemistry for quantities of simple sugars, amino acids, lipids, other extractives, lignin, and cellulose. See, e.g., Pettersen & Schwandt, *J. Wood Chem. & Technol.* 11:495 (1991).

In the present example, the phenotypes chosen for comparison are high density wood, average density wood, and low density wood. Nucleic acid samples are prepared as described in Example 3, from trees harvested in the spring and summer. Gene expression profiling by hybridization and data analysis is performed as described above.

Using similar techniques and clonally propagated individuals one can examine monolignol synthesis, monolignol transport, and lignin polymerization gene expression as it is related to other complex wood characteristics such as strength, stiffness and spirality.

Example 9

Example 9 demonstrates how a monolignol synthesis, monolignol transport, and lignin polymerization gene can be linked to a tissue-preferred promoter and expressed in pine resulting in a plant with increased wood density.

A monolignol synthesis, monolignol transport, and lignin polymerization gene, which is more highly expressed during the early spring, is identified by the method described in Example 7. A DNA construct having the density-related polypeptide operably linked to a xylem-preferred promoter is placed into an appropriate binary vector and transformed into pine using the methods described herein. Pine plants are transformed as described in herein and the transgenic pine plants are used to establish a forest planting. Increased density even in the spring wood (early wood) is observed in the transgenic pine plants relative to control pine plants which are not transformed with the density related DNA construct.

Example 10

Using techniques well known to those skilled in the art of molecular biology, the sequence of the monolignol synthesis, monolignol transport, or lignin polymerization gene isolated in Example 2 is analyzed in genomic DNA isolated from alfalfa. This enables the identification of an orthologue in alfalfa whose sequence is then used to create an RNAi knockout construct. This construct is then transformed into alfalfa. See, e.g., Austin et al., *Euphytica* 85, 381 (1995). The regenerated transgenic plants show lower fiber content and increased ray cell content in the xylem. Such properties improve digestability which results in higher growth rates in cattle fed on this alfalfa as compared to wild-type alfalfa of the same species.

Example 11

Example 11 demonstrates how gene expression analysis can be used to find gene variants which are present in mature plants having a desirable phenotype. The presence or absence of such a variant can be used to predict the phenotype of a mature plant, allowing screening of the plants at the seedling stage. Although this example employs eucalyptus, the method used herein is also useful in breeding programs for pine and other tree species.

The sequence of a putative density-related gene is used to probe genomic DNA isolated from *Eucalyptus* that vary in density as described in previous examples. Non-transgenically produced *Eucalyptus* hybrids of different wood phenotypes are examined. One hybrid exhibits high wood density and another hybrid exhibits lower wood density. A molecular marker in the 3' portion of the coding region is found which distinguishes a high-density gene variant from a lower density gene variant.

This molecular marker enables tree breeders to assay non-transgenic *Eucalyptus* hybrids for likely density profiles while the trees are still at seedling stage, whereas in the absence of the marker, tree breeders must wait until the trees have grown for multiple years before density at harvest age can be reliably predicted. This enables selective outplanting of the best trees at seedling stage rather than an expensive culling operation and resultant erosion at thinning age. This molecular marker is further useful in the breeding program to determine which parents will give rise to high density outcross progeny.

Molecular markers found in the 3' portion of the coding region of the gene that do not correspond to variants seen more frequently in higher or lower wood density non-transgenic *Eucalyptus* hybrid trees are also useful. These markers are found to be useful for fingerprinting different genotypes of *Eucalyptus*, for use in identity-tracking in the breeding program and in plantations.

Example 12

Example 12 describes microarrays for identifying gene expression differences that contribute to the phenotypic characteristics that are important in commercial wood, namely wood appearance, stiffness, strength, density, fiber dimensions, coarseness, cellulose and lignin content, lignin composition, extractives content and the like.

Woody trees of genera that produce commercially important wood products, in this case *Pinus* and *Eucalyptus*, are felled from various sites and at various times of year for the collection and isolation of RNA from developing xylem, cambium, phloem, leaves, buds, roots, and other tissues. RNA is also isolated from seedlings of the same genera.

All contigs are compared to both the ESTs made from RNA isolated from samples containing developing wood and the sequences of the ESTs made from RNA of various tissues that do not contain developing wood. Contigs containing primarily ESTs that show more hybridization in silico to ESTs made from RNA isolated from samples containing developing wood than to ESTs made from RNA isolated from samples not containing developing wood are determined to correspond to possible novel genes particularly expressed in developing wood. These contigs are then used for BLAST searches against public domain sequences. Those contigs that hybridize in silico with high stringency to no known genes or genes annotated as having only a "hypothetical protein" are selected for the next step. These contigs are considered putative novel genes showing wood-preferred expression.

The longest cDNA clones containing sequences hybridizing to the putative novel genes showing wood-preferred expression are selected from cDNA libraries using techniques well known to those skilled in the art of molecular biology. The cDNAs are sequenced and full-length gene-coding sequences together with untranslated flanking sequences are obtained where possible. Stretches of 45-80 nucleotides (or oligonucleotides) are selected from each of the sequences of putative novel genes showing wood-preferred expression such that each oligonucleotide probe hybridizes at high stringency to only one sequence represented in the ESTs made from RNA isolated from trees or seedlings of the same genus.

Oligomers are then chemically synthesized and placed onto a microarray slide as described in Example 4. Each oligomer corresponds to a particular sequence of a putative novel gene showing wood-preferred expression and to no other gene whose sequence is represented among the ESTs made from RNA isolated from trees or seedlings of the same genus.

Sample preparation and hybridization are carried out as in Example 4. The technique used in this example is more effective than use of a microarray using cDNA probes because the presence of a signal represents significant evidence of the expression of a particular gene, rather than of any of a number of genes that may contain similarities to the cDNA due to conserved functional domains or common evolutionary history. Thus, it is possible to differentiate homologous genes, such as those in the same family, but which may have different functions in phenotype determination.

This hybridization data, gained using the method of Example 6, enables the user to identify which of the putative novel genes actually possesses a pattern of coordinate expression with known genes, a pattern of expression consistent with a particular developmental role, and/or a pattern of expression that suggests that the gene has a promoter that drives expression in a valuable way.

The hybridization data obtained using this method can be used, for example, to identify a putative novel gene that shows an expression pattern particular to the tracheids with the lowest cellulose microfibril angle in developing spring wood (early wood). The promoter of this gene can also be isolated as in Example 8, and operably linked to a gene that has been shown as in Example 9 to be associated with late wood (summer wood). Transgenic pine plants containing this construct are generated using the methods of Example 9, and the early wood of these plants is then shown to display several characteristics of late wood, such as higher microfibril angle, higher density, smaller average lumen size, etc.

Example 13

Example 13 demonstrates the use of a xylem-specific promoter functionally linked to a monolignol synthesis, monolignol transport, and lignin polymerization gene for increased plant biomass.

Xylem-specific monolignol synthesis, monolignol transport, and lignin polymerization gene transcripts are identified via array analyses of different secondary vasculature layers as described in Example 6. Candidate promoters linked to the genes corresponding to these transcripts are cloned from pine genomic DNA using, e.g., the BD Clontech GenomeWalker kit and tested in transgenic tobacco via a reporter assay(s) for cambium specificity/preference. The xylem-specific promoter overexpressing a monolignol synthesis, monolignol transport, and lignin polymerization gene gene involved is used to increase wood biomass. A tandem xylem-specific promoter is constructed driving the monolignol synthesis, monolignol transport, or lignin polymerization gene synthesis gene ORF. Boosted transcript levels of the candidate monolignol synthesis, monolignol transport, or lignin polymerization gene result in an increased xylem biomass phenotype.

Example 14

Example 14 demonstrates the construction of a DNA construct for use in expressing the monolignol synthesis, monolignol transport, and lignin polymerization genes in *Pinus*.

A backbone vector is prepared by adding additional restriction endonuclease sites to the mulitple cloning site of the plasmid pBluescript (BRL Gibco Life Technologies, Gaithersburg Md.). The NotI and SstI sites in the original pBluescript vector are destroyed by digestion of the plasmid with NotI and SstI and filling in the ends using Klenow and T4 Polymerase (Invitrogen Corp., Carlsbad Calif.). The plasmid is circularized by blunt-end ligation and then digested with the restriction endonucleases EcoRI and HindIII to enable cloning of linkers. Linkers (phosphorylated at the 5' end) containing additional restriction sites are annealed together and ligated into the EcoRI/HindIII-digested pBluescript vector. Unless otherwise noted, DNA constructs, primers useful for preparing such constructs and elements included in such constructs are depicted in TABLE 12.

The 3' UTR from the *P. radiata* superubiquitin gene (U.S. Pat. No. 6,380,459) is cloned into the plasmid pBI-121 (See Jefferson et al., *EMBO J.* 6:3901-3907 (1987)). First, a fragment of the 3' UTR of the gene is amplified using standard PCR techniques. These primers can contain additional nucleotides and, in this case, can contain an SstI restriction site for cloning into SstI-digested plasmid pBI-121. Then, the 3' UTR fragment, containing the nos terminator, is transferred to the pBluescript plasmid. The 3' UTR and nos terminator fragment of pBI-121 is amplified with PCR, cleaved with KpnI and ClaI and cloned into the modified pBluescript digested with KpnI and ClaI.

To this construct, the *P. radiata* superubiquitin promoter sequence with intron is added. The promoter/intron sequence is first amplified from the *P. radiata* superubiquitin sequence identifed in U.S. Pat. No. 6,380,459 (denoted therein as SEQ ID NO: 2) using standard PCR techniques. The amplified fragment is then ligated into the base vector using XbaI and PstI restriction digestion.

The *P. radiata* 4CL intron sequence from the *P. radiata* cDNA is amplified using standard PCR, then cloned into XcmI-digested vector backbone using T-tailed ligation.

A fragment from a *P. radiata* 4CL cDNA clone is amplified using standard PCR techniques (fragments A to G are depicted in SEQ ID NO: 789-795). Portions of the *P. radiata* 4CL cDNA clone were disclosed in U.S. Pat. Nos. 6,410,718 and 5,850,020. The primers are designed to add PstI and ClaI restriction sites to both ends of the amplified fragments. To clone the *P. radiata* 4CL fragment in the sense orientation, the amplified fragment is cut with the restriction enzyme PstI, blunt ended using Klenow and cloned into the backbone vector in a blunt-ended ClaI site. To clone the *P. radiata* 4CL fragment in the antisense orientation, the amplified fragment is digested with PstI and cloned into the PstI-digested backbone vector.

The complete RNAi cassette containing the promoter:: sense fragment::intron::antisense fragment::3'UTR::nos terminator construct, is removed from the pBluescript plasmid by a NotI restriction digestion, and cloned into the binary vector pART29 (digested with NotI) using standard cloning techniques. The resulting DNA construct is labeled pARB513. The binary vector pART29 is a modified pART27 vector (Gleave et al., *Plant Mol. Biol.* 20:1203-1207 (1992)) that lacks the lacZ sequences and contains the *Arabidopsis thaliana* ubiquitin 3 (UBQ3) promoter in place of the nos 5' promoter.

The pWVK147 vector is a pBI121 vector (Clontech laboratories, Palo Alto Calif.) with the 35S promoter GUS sequence removed and the nos promoter replaced with the UBQ10 promoter from *Arabidopsis* (Sun et a;. *Plant J.* 11:101-111 (1997)) operably linked to the nptII gene. A unique HpaI restriction site was added to pBI121 by the addition of an adapter ligated at the ApaI and KpnI sites.

The DNA constructs listed in TABLE 13 are assembled as described above but with modifications in at least one of the following: gene sequences; the promoter, and/or the binary vector.

To clone a different promoter as listed in TABLE 13 into the final vector, the *P. radiata* superubiquitin promoter intron vector is digested with SmaI and SstI restriction enzymes and using standard techniques. This fragment is cloned into a Bluescript vector containing either a 4CL promoter from *P. taeda*, an COMT promoter from *Eucalyptus grandis*, or a LIM promoter from *P. radiata*. The *P. taeda* 4CL promoter (U.S. Pat. No. 6,252,135 denoted therein as SEQ ID NO: 11), the *E. grandis* COMT promoter (as described in Example 1 of U.S. patent publication No. 20040146904), and the *P. radiata* LIM promoter (U.S. Patent publication No. 20040163146) are cloned with a similar strategy to the assembly of the *P. radiata* superubiquitin promoter sequence with intron and as described above. The complete RNAi cassette containing the promoter::sense fragment::intron::antisense fragment::3'UTR::nos terminator construct, is removed from the pBluescript plasmid by a NotI restriction digestion, and cloned into the binary vector pART29 or pWVK147 (digested with NotI).

TABLE 13

| Final Vector | Binary Vector | Promoter |
|---|---|---|
| pARB553 | pWVK147 | *Pinus radiata* SuperUbiq + Intron (U.S. Pat. No. 6,380,459) |
| pARB555 | pWVK147 | *Pinus taeda* 4CL (U.S. Pat. No. 6,252,135) |
| pARB561 | pWVK147 | *Eucalyptus grandis* COMT (U.S. Pat. Publication No. 20040146904) |
| pARB562 | pWVK147 | *Pinus radiata* LIM (U.S. Pat. publication No. 20040163146) |
| pARB515 | pART29 | *Pinus taeda* 4CL (U.S. Pat. No. 6,252,135) |
| pARB534 | pART29 | *Pinus radiata* LIM (U.S. Pat. publication No. 20040163146) |

The DNA constructs in TABLE 14 are constructed using the same methods as those described above, except that the PDK intron sequence (see Wesley et al., *Plant J.* 27:581-590 (2001)) was amplified using standard PCR techniques and operably linked to the remaining portions of the DNA construct (PDK Intron sequence and primers depicted in SEQ ID NO: 814-816).

TABLE 14

| Final Vector | Binary Vector | Promoter |
|---|---|---|
| pARB554 | pWVK147 | *Pinus radiata* SuperUbiq + Intron (U.S. Pat. No. 6,380,459) |
| pARB556 | pWVK147 | *Pinus taeda* 4CL (U.S. Pat. No. 6,252,135) |
| pARB557 | pWVK147 | *Eucalyptus grandis* COMT (U.S. Pat. Publication No. 20040146904) |
| pARB558 | pWVK147 | *Pinus radiate* LIIM (U.S. Pat. publication No. 20040163146) |
| pARB514 | pART29 | *Pinus radiata* SuperUbiq + Intron (U.S. Pat. No. 6,380,459) |
| pARB516 | pART29 | *Pinus taeda* 4CL (U.S. Pat. No. 6,252,135) |
| pARB518 | pART29 | *Pinus radiata* LIM (U.S. Pat. publication No. 20040163146) |

The DNA constructs in TABLE 15 are constructed as described above and as follows. The YABBY intron sequence (see Foster et al., *Plant Cell.* 14(7):1497-1508 (2002)) is amplified using primers similarly designed to those above for the 4CL and PDK intron sequences and cloned into the vector backbone. Six additional fragments (fragments A through F and depicted in SEQ ID NOs: 789-795) are amplified with primers similarly designed to those used above. Primers for 4CL fragment A are designed to add a SmaI restriction sites to both ends of the amplified fragment; primers for 4CL fragment B are designed to add EcoRI and HindIII restriction sites at both ends of the amplified fragment; primers for 4CL fragment E are designed to add PstI restriction sites at both ends of the amplified fragment; and primers for 4CL fragment F are designed to add a SmaI restriction site to the one end and EcoRI and HindIII restriction sites to the other end of the amplified fragment. All seven fragments are cloned in the sense and antisense directions into the backbone vector as described above or by using the listed restriction enzymes. The complete RNAi cassette containing the promoter::sense fragment::intron::antisense fragment::3'UTR::nos terminator construct, is removed from the pBluescript plasmid as described above, and cloned into the binary vector pART27 or pART29 (digested with NotI). The binary vector pART29 is a modified pART27 vector (Gleave, *Plant Mol. Biol.* 20:1203-1207 (1992)) that contains the *Arabidopsis thaliana* ubiquitin 3 (UBQ3) promoter instead of the nos 5' promoter and no lacZ sequences. Modifications to the promoter from the *Pinus radiata* Superubiquitin promoter plus intron to *P. taeda* 4CL, *E. grandis* COMT or *P. radiata* LIM promoters are as described above.

TABLE 15

| Final Vector | Binary Vector | Promoter | Fragment |
|---|---|---|---|
| pARB318 | pART27 | *Pinus radiata* SuperUbiq + Intron (U.S. Pat. No. 6,380,459) | 4CL fragment A (SEQ ID NO: 789) |
| pARB319 | pART27 | *Pinus radiata* SuperUbiq + Intron (U.S. Pat. No. 6,380,459) | 4CL fragment B (SEQ ID NO: 790) |
| pARB320 | pART27 | *Pinus radiata* SuperUbiq + Intron (U.S. Pat. No. 6,380,459) | 4CL fragment C (SEQ ID NO: 791) |
| pARB321 | pART27 | *Pinus radiata* SuperUbiq + Intron (U.S. Pat. No. 6,380,459) | 4CL fragment D (SEQ ID NO: 792) |
| pARB322 | pART27 | *Pinus radiata* SuperUbiq + Intron (U.S. Pat. No. 6,380,459) | 4CL fragment E (SEQ ID NO: 793) |

TABLE 15-continued

| Final Vector | Binary Vector | Promoter | Fragment |
|---|---|---|---|
| pARB323 | pART27 | *Pinus radiata* SuperUbiq + Intron (U.S. Pat. No. 6,380,459) | 4CL fragment F (SEQ ID NO: 794) |
| pARB324 | pART27 | *Pinus radiata* SuperUbiq + Intron (U.S. Pat. No. 6,380,459) | 4CL fragment G (SEQ ID NO: 795) |
| pARB332 | pART27 | *Pinus taeda* 4CL (U.S. Pat. No. 6,252,135) | 4CL fragment A (SEQ ID NO: 789) |
| pARB333 | pART27 | *Pinus taeda* 4CL (U.S. Pat. No. 6,252,135) | 4CL fragment B (SEQ ID NO: 790) |
| pARB334 | pART27 | *Pinus taeda* 4CL (U.S. Pat. No. 6,252,135) | 4CL fragment C (SEQ ID NO: 791) |
| pARB335 | pART27 | *Pinus taeda* 4CL (U.S. Pat. No. 6,252,135) | 4CL fragment D (SEQ ID NO: 792) |
| pARB336 | pART27 | *Pinus taeda* 4CL (U.S. Pat. No. 6,252,135) | 4CL fragment E (SEQ ID NO: 793 |
| pARB337 | pART27 | *Pinus taeda* 4CL (U.S. Pat. No. 6,252,135) | 4CL fragment F (SEQ ID NO: 794) |
| pARB338 | pART27 | *Pinus taeda* 4CL (U.S. Pat. No. 6,252,135) | 4CL fragment G (SEQ ID NO: 795) |
| pARB145 | pART29 | *Pinus radiata* SuperUbiq + Intron (U.S. Pat. No. 6,380,459) | 4CL fragment A (SEQ ID NO: 789) |
| pARB146 | pART29 | *Pinus radiata* SuperUbiq + Intron (U.S. Pat. No. 6,380,459) | 4CL fragment B (SEQ ID NO: 790) |
| pARB147 | pART29 | *Pinus radiata* SuperUbiq + Intron (U.S. Pat. No. 6,380,459) | 4CL fragment C (SEQ ID NO: 791) |
| pARB148 | pART29 | *Pinus radiata* SuperUbiq + Intron (U.S. Pat. No. 6,380,459) | 4CL fragment D (SEQ ID NO: 792) |
| pARB149 | pART29 | *Pinus radiata* SuperUbiq + Intron (U.S. Pat. No. 6,380,459) | 4CL fragment E (SEQ ID NO: 793) |
| pARB150 | pART29 | *Pinus radiata* SuperUbiq + Intron (U.S. Pat. No. 6,380,459) | 4CL fragment F (SEQ ID NO: 794) |
| pARB151 | pART29 | *Pinus radiata* SuperUbiq + Intron (U.S. Pat. No. 6,380,459) | 4CL fragment G (SEQ ID NO: 795) |
| pARB183 | pART29 | *Pinus taeda* 4CL (2249 bp fragment of U.S. Pat. No. 6,252,135) | 4CL fragment A (SEQ ID NO: 789) |
| pARB184 | pART29 | *Pinus taeda* 4CL (U.S. Pat. No. 6,252,135) | 4CL fragment B (SEQ ID NO: 790) |
| pARB185 | pART29 | *Pinus taeda* 4CL (U.S. Pat. No. 6,252,135) | 4CL fragment C (SEQ ID NO: 791) |
| pARB186 | pART29 | *Pinus taeda* 4CL (U.S. Pat. No. 6,252,135) | 4CL fragment D (SEQ ID NO: 792) |
| pARB187 | pART29 | *Pinus taeda* 4CL (U.S. Pat. No. 6,252,135) | 4CL fragment E (SEQ ID NO: 793) |
| pARB188 | pART29 | *Pinus taeda* 4CL (U.S. Pat. No. 6,252,135) | 4CL fragment F (SEQ ID NO: 794) |
| pARR189 | pART29 | *Pinus taeda* 4CL (U.S. Pat. No. 6,252,135) | 4CL fragment G (SEQ ID NO: 795) |

The vector pARB310 (SEQ ID NO: 796) was developed by deleting several nonessential regions from the vector pBI121 (Clontech Laboratories, Palo Alto Calif.), replacing almost all of the DNA between the Right and Left Borders with a new multiple cloning site (Asc I, Not I, Apa I, Xho I, Sma I, Pst I, and Kpn I), and inserting a plant selectable marker comprising the UBIQUITIN3 (UBQ3) promoter from *Arabidopsis* (Norris, S. R. et al. (1993) Plant Mol. Biol. 21, 895-906) linked to the NPTII coding region and nos terminator. The barstar expression cassette from pMT416 (Hartley, R. W., *J. Mol. Biol.* 202:913-915 (1988)) was amplified using primers SEQ ID NO: 798 and 799 and cloned into an intermediate vector. The approximately 470 bp barstar fragment was obtained by digestion with BstX I and was subsequently clned into the BstX I site of pARB310 to yield the vector pARB310B.

The ColE1 replication origin and approximately 1 kb of flanking sequence was amplified from the vector pART27 (Gleave, *Plant Mol. Biol.* 20:1203-1207 (1992)) using the primers SEQ ID NO: 800 and 801. This ColE1 fragment was digested with BamH I and Bcl I, purified and ligated into the Bcl I site of pARB310B, between the end of the trfA gene and the left border (LB) of the T-DNA, to generate the vector pAGF50. pAGF50 was digested with Asc I and Nco I to remove the UBQ3 promoter plus most of the NPTII coding region and the resulting 5.7 kb fragment was gel purified.

The 5'-end of the selectable marker cassette was replaced with a corresponding segment from plasmid pWVR3 (SEQ ID NO: 802), which had the promoter from UBIQUITIN10 (UBQ10) linked to the NPTII coding region. For the initial construction of the donor plasmid, the 1.3 kb promoter fragment of UBQ10, comprising ~900 bp of upstream sequence, an untranslated exon of >40 bp, a ~300 bp intron, and the initiation codon (Norris et al., *Plant Mol. Biol.* 21:895-906 (1993)), was amplified using PCR primers SEQ ID NO: 803 and 804. The NPTII coding sequence was amplified from pBI121 (Clontech laboratories, Palo Alto Calif.) using primers SEQ ID NO: 805 and 806, and the nopaline synthase transcription terminator (NOSTER) was amplified using primers SEQ ID NO: 807 and 808. The NPTII and NOSTER fragments were amplified separately in order to remove ~300 bp of extraneous DNA found in pBI121. The primers UBQ10P3 and NPT2-5A are complementary to each other, which enabled the 3'-end of the promoter fragment to anneal to the 5'-end of the NPTII coding region fragment. A similar complementarity was used for the primers at the 3'-end of the NPTII fragment and the 5'-end of the terminator fragment, allowing the complete cassette to be formed without ligation. The three fragments were gel purified after being produced individually by PCR and were mixed with components of a normal PCR reaction (buffer, dNTPs, and TaqPlus Long polymerase). Each of the three fragments was present at approximately 10 ng/microL in a total of 20 microL. The mixture was denatured, then allowed to anneal and extend for 5 cycles. This reaction was then diluted to 200 microL with a fresh PCR reaction mixture, which included phosphorylated primers SEQ ID NO: 803 and SEQ ID NO: 808 for amplification of the full-length cassette, and underwent 10 further cycles. The resulting fragment was ligated into Sma I-digested pBluescript SK. After sequence verification, it was found that all isolated clones had mutations in them, thus non-mutated portions of two isolates were recombined to produce pWVR3. The 1.9 kb fragment with the UBQ10 promoter linked to the 5'-end of the NPTII coding region was released from pWVR3 by Asc I and Nco I digestion, gel purified, and ligated into the pAGF50 fragment to generate pARB1000.

Plasmid pARB1000 was modified by the addition of a SUBIN::GUSIN::nos terminator reporter cassette at the Sma I site to generate pARB1001 (SEQ ID NO: 809). (SUBIN is the *Pinus radiata* superubiquitin promoter plus 5'-UTR plus intron (U.S. Pat. No. 6,380,459), and GUSIN is the GUS coding region interrupted by the potato tuberin gene intron (Vancanneyt et al., *Mol. Gen. Genet.* 220:245-250 (1990)). The male-specific flowering control gene, PrMC2.400-1::barnaseH102E::RNS2TER, was present in pWVR219 (SEQ ID NO: 810), with an unwanted Not I site near the 3'-end. The plasmid was digested with Not I, and then the site was destroyed by treating with T4 DNA polymerase in the presence of dNTPs and religating the vector. The PrMC2.400-1::barnaseH102E::RNS2TER cassette was excised from the altered pWVR219 with Asc I and Xho I, and the 1.1 kb fragment was gel purified. pARB1001 was prepared by partial digestion with Xho I to linearize the plasmid, followed by complete digestion with Asc I and purification of the 12.3 kb fragment. The PrMC2.400-1::barnaseH102E::RNS2TER cassette was ligated into the prepared pARB1001 vector to generate pARB1002 (SEQ ID NO: 811). The structure of the plasmid was verified with single-pass sequencing.

The (AtAGenh) PrAG::barnaseE73G::NOSTER cassette was removed from pWVCZ24 (SEQ ID NO: 812) by EcoR I and Asc I digestion. A Not I adapter comprising the oligo-nucleotides, EcoNot1 (5'-AATGCGGCCGCAGAGA-3') and EcoNot2 (5'-TCTCTGCGGCCGC-3'), was ligated to the EcoR I site and digested with Not I, and then the 4.9 kb fragment was purified. The plasmid pARB1001 was digested with Not I and Asc I and the 7.6 kb vector fragment was gel purified. The above cassette was ligated into these sites to generate pARB1005L (SEQ ID NO: 813). The structure of the plasmid was verified with single-pass sequencing.

Example 15

Example 15 demonstrates the assembly of a DNA contruct for use in expressing the monolignol synthesis CCoAOMT (Caffeoyl-coenzyme A o-Methyltransferase) gene in *Pinus*.

The vectors in TABLE 16 are cloned as described in Example 14 with the following changes. A fragment from the *Pinus* CCoAOMT gene (nucleotides 793-1016 of SEQ ID NO: 80 is amplified using standard PCR techniques. To clone the fragment in the sense orientation, the amplified fragment is cut with the restriction enzyme PstI, and cloned into the backbone vector. To clone the fragment in the antisense orientation, the amplified fragment is digested with ClaI and cloned into the backbone vector. The final DNA constructs are also modified by means of the addition of the PDK intron, the use of either the *P. radiata* Superubiquitin promoter with intron or the *P. taeda* 4CL promoter and the use of the pWVK147 binary vector using the methods described in Example 14.

TABLE 16

| Final Vector | Promoter | Fragment |
| --- | --- | --- |
| pARB559 | *Pinus radiata* SuperUbiq + Intron (U.S. Pat. No. 6,380,459) | Nucleotides 793-1016 of SEQ ID NO: 80 |
| pARB560 | *Pinus taeda* 4CL (U.S. Pat. No. 6,252,135) | Nucleotides 793-1016 of SEQ ID NO: 80 |

Example 16

Example 16 demonstrates the assembly of *E. grandis* CCoAOMT (Caffeoyl-coenzyme A O-Methyltransferase) DNA constructs.

The DNA constructs in TABLE 17 are cloned as described in Example 14, with the following modifications. A fragment from the *E. grandis* CCoAOMT (nucleotides 745-904 of SEQ ID NO: 223) is amplified using standard PCR tecnique in accordance with Example 15. The final vectors are also modified by the addition of the PDK intron or the *Eucalyptus* xylem intron which are well know in the art such as described by Wesley et al. 2001 Plant J. 27: 581-590, the *E. grandis* COMT promoter and the use of the pART29 binary vector using the methods described above.

TABLE 17

| Final Vector | Promoter::Intron | Fragment |
| --- | --- | --- |
| pARB523 | *E. grandis* COMT promoter::PDK intron | Nucleotides 745-904 of SEQ ID NO: 223 |
| pARB524 | *E. grandis* COMT promoter::Eucalyptus xylem intron (International patent publication no. WO00/22092) | Nucleotides 745-904 of SEQ ID NO: 223 |

Example 17

Example 17 demonstrates the assembly of *E. grandis* CCR (cinnamoyl CoA reductase) DNA constructs.

The DNA constructs of TABLE 18 are cloned as described in Example 14, except that a fragment from the *E. grandis* CCR clone (nucleotides 1038-1326 of SEQ ID NO: 121) is amplified. The final vectors are also modified by the addition of the PDK intron or the *Eucalyptus* xylem intron which are well know in the art such as described by Wesley et al. 2001 Plant J. 27: 581-590, the *E. grandis* COMT promoter and the use of the pART29 binary vector.

TABLE 18

| Final Vector | Promoter::Intron | Fragment |
| --- | --- | --- |
| pARB525 | *E. grandis* COMT promoter::PDK intron | Nucleotides 1038-1326 of SEQ ID NO: 121 |
| pARB526 | *E. grandis* COMT promoter::Eucalyptus xylem intron (International patent publication no. WO00/22092) | Nucleotides 1038-1326 of SEQ ID NO: 121 |

Example 18

Example 18 demonstrates the assembly of *E. grandis* C3H and C4H DNA constructs.

The DNA constructs in TABLE 19 cloned as described in Example 14, with the modifications that the fragments from the *E. grandis* C3H clones (SEQ ID NO: 817) or *E. grandis* C4H clones (SEQ ID NO: 191) is amplified using standard PCR tecnique in accordance with Example 15. Either the Arabinogalactan promoter (SEQ ID NO: 764) from *E. grandis* or the 4CL promoter of *P. taeda* (U.S. Pat. No. 6,252,135 as depicted therein as SEQ ID NO: 11) are operably linked to the C3H or C4H fragments. The *P. radiata* superubiquitin promoter intron vector is digested with the BamHI restriction enzyme using standard techniques. This fragment is cloned into a Bluescript vector containing either the 4CL promoter from *P. taeda* (digested with BamHI) or the Arabinogalactan promoter from *E. grandis* (digested with Clap. The *P. taeda* 4CL promoter and the *E. grandis* Arabinogalactan promoter are both amplified using primers similarly designed to those used to amplify the *P. radiata* superubiquitin promoter sequence with intron and then ligated into the base bluescript vector as described in Example 14. The final vector can also modified by the addition of the Pr4CL intron, and the use of the pARB1002 binary vector, using the methods described in Example 15.

TABLE 19

| Final Vector | Promoter | Fragment |
| --- | --- | --- |
| pARB669 | *Eucalyptus grandis* Arabinogalactan promoter (SEQ ID NO: 764) | SEQ ID NO: 817 |
| pARB670 | *Eucalyptus grandis* Arabinogalactan promoter (SEQ ID NO: 764) | SEQ ID NO: 191 |
| pARB672 | *Pinus taeda* 4CL promoter (2249 bp fragment of U.S. Pat. application 6,252,135) | SEQ ID NO: 191 |

Example 19

Example 19 demonstrates the assembly of DNA constructs for the modulation of lignin composition by increasing the percentage of sinapyl lignin monomers.

In this Example, the backbone vector pWVR5 was a pBI121 vector (Clontech laboratories, Palo Alto Calif.) with the 35S promoter GUS sequence removed and the NOS promoter replaced with the UBQ10 promoter from *Arabidopsis* (Sun, C. W. and J. Callis, *Plant J.*, 11:101-111 (1997)).

The vector pARB459 was developed using the following steps. The Bluescript vector (Stratagene, La Jolla, Calif.) was modified by operably linking the Superubiquitin 3'UTR and nos 3' terminator sequence to the Bluescript vector sequences. The resulting DNA construct was named pARB005 (SEQ ID NO: 775).

The *P. radiata* superubiquitin promoter with intron was added to pARB005. The promoter/intron sequence was first amplified from the *P. radiata* superubiquitin sequence identifed in U.S. Pat. No. 6,380,459 using standard PCR techniques and the primers depicted in SEQ ID NOs: 776 and 777. The amplified fragment was ligated into pARB005 to assemble the DNA construct pARB119 (SEQ ID NO: 778). The sweetgum (*Liquidambar styraciflua*) Cald5H gene (Osakabe et al., *Proc Natl Acad Sci U.S.A.* 96(16):8955-8960 (1999)) was then amplified using standard PCR techniques and the primers depicted in SEQ ID NOs: 779 and 780. The amplified fragment was ligated to pARB119 to produce the vector pARB459 (SEQ ID NO: 781).

The sweetgum Cald5H gene Cald5H gene (Osakabe et al., *Proc Natl Acad Sci U.S.A.* 96(16):8955-8960 (1999)) was cloned into pWVR5 to produce the DNA construct pWVC50 (SEQ ID NO: 757). pWVR5 was digested using NotI, separated on a 1% agarose gel, and purified. The purified DNA is treated with SAP (shrimp alkaline phosphatase) before the *P. radiata* superubiquitin promoter::Cald5H cassette is added and ligated using T4 DNA ligase. The *P. radiata* superubiquitin promoter::Cald5H terminator cassette was isolated from the vector pARB459 after digestion with NotI.

The *E. grandis* EGBA SAD gene (SEQ ID NO: 149) operably linked to the *Eucalyptus* Arabinogalactan promoter was cloned into the pWVR5 vector to produce the DNA construct pWVC51 (SEQ ID NO: 758). The vector pWVR5 was digested using NotI, separated on a 1% agarose gel, and purified. The purified DNA was treated with SAP (shrimp alkaline phosphatase) before the EGBA SAD gene was added and ligated using T4 DNA ligase. The Euc Arabinoglactan promoter::EGBA SAD::ter cassette was isolated from the vector pARB487 after digestion with NotI.

The vector pARB487 can be derived using the following steps. The Arbinogalactan promoter was isolated as described above and operably linked to the *E. grandis* EGBA SAD gene (SEQ ID NO: 149) using PCR primers having unique cloning sequences. This fragment was used to assemble the DNA construct pARB453. The Euc Arabinoglactan promoter::EGBA SAD::ter cassette was removed from pARB453 by digesting the DNA with NotI and ligated into the NotI site of pART29 to assemble the DNA construct pARB487.

The sweetgum BioMT gene can be cloned into the pWVR5 vector to produce the vector pWVC55 (SEQ ID NO: 759). The vector pWVR5 was digested using NotI, separated on a 1% agarose gel, and purified. The DNA was treated with SAP (shrimp alkaline phosphatase) before the BioMT gene fragment was added and ligated using T4 DNA ligase. The *P. taeda* 4CL promoter::sweetgum BioMT::3'UTR/nos terminator fragment was isolated from the vector pARB257 after digestion with NotI.

The vector pARB257 was assembled as follows. The *P. taeda* 4CL promoter of U.S. Pat. No. 6,252,135 is amplified using PCR. The sweetgum BioMT gene was amplified using PCR primers (SEQ ID NOs: 782 and 783) having unique restriction ezyme sequences. The fragment was then used to assemble the DNA construct pARB156. The *P. taeda* 4CL promoter::sweetgum BioMT::3'UTR/nos terminator casesette was removed from pARB156 by digesting the vector with NotI and ligated into the NotI site of pARB5 to assemble the DNA construct pARB257.

In order to assemble the DNA construct pWVC56 (SEQ ID NO: 760), the DNA construct pWVC52 was assembled first. The *Eucalyptus* Arabinogalactan promoter::EGBA SAD fragment was removed from pWVC51 (SEQ ID NO: 758) using the restriction enzyme KpnI. This fragment and the *P. radiata* superubiquitin promoter::Cald5H gene from pARB459 (as described above) were cloned into the pWVR5 vector sat the NotI site. This construct was analyzed using standard techniques for the presence of both inserts in the required orientation. The resulting construct was named pWVC52.

pWVC56 (SEQ ID NO: 760) was constructed by removing the *P. taeda* 4CL promoter from pWVC55 (SEQ ID NO: 759) using the restriction enzymes EcoRV and SbfI. The resulting fragment was ligated with pWVC52 after that DNA construct was digested with the restriction enzymes SrfI and SbfI. The final plasmid was verified by restriction digest using standard methods.

The control DNA construct pWVR31 was engineered from pWVR8 (*Arabidopsis* ActinII::GUSINT, UBQ10::NPTII). The UBQ11 promoter from *Arabidopsis* (Norris et al., *Plant Mol Biol.* 21(5):895-906 (1993)) was amplified by PCR using the primers SEQ ID NO: 771 and 772. This fragment was then cloned into pWVR8 in place of the ActinII promoter. The resulting construct was pWVR31.

Example 20

Example 20 demonstrates the assembly of DNA constructs for use in *Arabidopsis* complementation experiments.

The DNA construct pARB460 (SEQ ID NO: 762) was constructed by removing the *P. radiata* superubiquitin promoter::Cald5H cassette from pARB459 (described above in Example 19) using the restriction enzyme NotI. The resulting fragment was cloned into the NotI site of pART27 (Gleave et al., *Plant Mol. Biol.* 20:1203-1207 (1992)).

The DNA construct pARB373 (SEQ ID NO: 763) was constructed as follows. The *E. grandis* Arabinogalactan promoter was initially isolated as described in Example 19. This fragment was then cloned into pARB005 (described above in Example 19) to assemble pARB154. The sweetgum Cald5H gene (Osakabe et al., *Proc. Natl. Acad. Sc.i U.S.A.* 96(16): 8955-60 (1999)) was then cloned into pARB154 in the sense orientation operably linked to the Arabinogalactan promoter. The resulting construct was pARB262 (SEQ ID NO: 786). The *E. grandis* Arabinogalactan promoter::Cald5H:: 3'UTR/nos terminator cassette was removed from pARB262 using NotI and cloned into the NotI of pART27 (Gleave et al., *Plant Mol. Biol.* 20:1203-1207 (1992)) to assemble pARB373.

The DNA construct pARB595 (SEQ ID NO: 784) was assembled as follows. The *Eucalyptus* Cald5H gene (SEQ ID NO: 186) was amplified using standard PCR techniques. The amplified fragment was then ligated into pARB119 to assemble pARB594. The SuperUbiquitin promoter:: EucCald5H::3'UTR/nos terminator cassette was removed from pARB594 and cloned into the NotI of pART27 (Gleave et al., *Plant Mol. Biol.* 20:1203-1207 (1992)) using standard techniques to produce pARB595.

The DNA construct pARB597 (SEQ ID NO: 785) was assembled as follows. The *Eucalyptus* Cald5H gene (SEQ ID NO: 185) was amplified using standard PCR techniques. The amplified fragment is then ligated into pARB119 to assemble pARB596. The SuperUbiquitin promoter::EucCald5H:: 3'UTR/nos terminator cassette was removed from pARB596 and cloned into the NotI of pART27 (Gleave et al., *Plant Mol. Biol.* 20:1203-1207 (1992)) using standard techniques to produce pARB597.

Example 21

Example 21 demonstrates the transformation of *Arabidopsis* plants with the inventive DNA constructs of Example 20.

*Arabidopsis* fah1 mutant plants were transformed with *Agrobacterium* containing the DNA constructs of Example 20 by floral dip infiltration. Briefly, *Agrobacterium* cultures were centrifuged at ~8600 rcf for 10 minutes at 20° C. and were resuspended to an optical density of ~0.7-0.8. Plants were dipped into an infiltration solution containing the *Agrobacterium* for about 5 seconds. Plants were drained of excess solution and placed under grow lights in ambient conditions. After about 24 hours, the plants were misted and maintained for seed production. $T_1$ seeds were surface sterilized in 5% commercial bleach solution and plated on MS media containing Kanamycin (50 mg/l) and Timentin (250 mg/l) to select for putative transformants.

Once selected, putative transformants were transferred to rockwool and grown for four weeks before testing.

Example 22

Example 21 demonstrates the modulation of lignin composition in *Arabidopsis* plants transformed with the inventive DNA constructs of Example 20.

The *Arabidopsis* fah1 mutant was defective in ferulate 5-hydroxylase. See Chapple et al., *Plant Cell.* 4(11):1413-1424 (1992). In this mutant *Arabidopsis* plant, lignin composition was marked by the complete absence of syringyl (S) subunits (Marita et al., *Proc. Natl. Acad. Sci. U.S.A.* 96(22): 12328-12332 (1999)). Likewise, the mutant plant was completely devoid of sinapoyl esters. The inventive DNA constructs of Example 20, pARB595 and pARB597, were transformed into *Arabidopsis* fah1 mutant plants using the transformation method described in Example 21.

HPLC analysis (Agilent HPLC 1100 series—Germany) was used to determine the presence of sinapoyl malate in the transformed plants, fah1 mutant plants, and wild-type *Arabidopsis* plants. HPLC was performed using standard procedures. In brief, leaf extracts were analysed by both UV and mass spectrometry (Agilent Mass Spec 1100 series LC/MSD Trap—Germany) in each run. The instrument diode array detector was set to measure UV absorbance at 330 nm. The Ion Trap mass spectrometer was operated in negative mode ionisation to detect chemical species that could be deprotonated, e.g., those chemical species containing acidic groups such as sinapoyl malate. During the gradient, a spectrometric peak was observed on the UV 330 nm trace corresponding to a peak giving rise to a spectrum whose major components were singly charged and had mass to charge (m/z) ratios of 339.2 and 223.1. Sinapoyl malate (C15H16O9) has a molecular weight of 340.28 g/mol—once deprotonated a skilled artisan would expect to see a peak with a mass to charge ratio of 339.28. The m/z 339.2 species was isolated in the ion trap and when fragmented can be found to give rise to the m/z 223 species. The 223 m/z ratio equates to a species that one skilled in the art would expect from the deprotonated sinapoyl moiety from sinapoyl malate. The m/z 223 species can be isolated in the ion trap and if fragmented can give gave rise to a spectrum that a skilled artisan would understand accounts for the structure of the sinapoyl moiety.

Accordingly, those skilled in the art would know that the peak of interest in the chromatogram is sinapoyl malate that has been fragmented into the sinapoyl species before reaching the trap due to in-source collision induced dissociation (CID). This can be confirmed by varying the skimmer voltage to reduce (CID). If done, this action can allow tha capture of more intact sinapoyl malate.

FIGS. 227 and 228 demonstrate the intensity of the peak of interest in the transformed plants, fah1 mutant plants, and wild-type *Arabidopsis* plants. Plants transformed with pARB597 comprise the structural gene depicted in SEQ ID NO: 185 (the *Eucalyptus* Cald5H gene). Plants transformed with pARB595 comprise the structural gene depicted in SEQ ID NO: 186 (the *Eucalyptus* Cald5H gene).

As can been seen in FIGS. 227 and 228, a majority of the transformed plants demonstrated levels of sinapoyl malate similar to those in wild-type *Arabidopsis* plants (except in one pARB597-transformed plant). Similar levels of sinapoyl malate were not seen in samples from *Arabidopsis* fah1 mutant plants. Accordingly, those skilled in the art would recognize the inventive DNA constructs complement the fah1 mutantion of *Arabidopsis*. In addition, those skilled in the art would recognize that the inventive DNA constructs have the ability to produce syringyl lignin units in plants. As such, these constructs are useful in the forestry industry to improve the pulping qualities of wood Example 23

Example 23 demonstrates the staining of a sample from the transformed *Arabidopsis* fah1 mutant plants of Example 22.

Hand-cut stem and hypocotyls samples from a pARB595-transformed *Arabidopsis* fah1 mutant plant of Example 22, an *Arabidopsis* fah1 mutant plant, and a wild-type *Arabidopsis* plant were stained with Maule reagent. Proctols for staining plant tissue with Maule reagents are well known in the art, and a detailed description can be found at Strivastava L M, *T.A.P.P.I.* 49:173-183 (1966). In short, Maule reagent allows the determination of the level of syringyl ligin in a plant sample. Samples were scored for the presence or absence of stain on a semi-quantitative scale (– to +++). TABLE 20 presents the staining results for a pARB595-transformed *Arabidopsis* fah1 mutant plant of Example 22, an *Arabidopsis* fah1 mutant plant, and a wild-type *Arabidopsis* plant.

TABLE 20

|  | pARB595-Transformed *Arabidopsis fah1* Mutant Plant | *Arabidopsis fah1* Mutant Plant | Wild-Type *Arabidopsis* Plant |
| --- | --- | --- | --- |
| Stem section | +++ | + | – |
| Hypocotyl section | +++ | + | – |

As indicated in TABLE 20, the transformation of a *Arabidopsis* fah1 mutant plant correlates with the increased production of syringyl lignin, even in excess of the syringyl lignin present in wild-type *Arabidopsis* plants. Accordingly, those skilled in the art would recognize the increase in sinapoyl malate observed in Example 22 correlates to an increase in syringyl lignin in transformed *Arabidopsis* fah1 mutant plants.

Example 24

Example 24 demonstrates the transformation of *Eucalyptus grandis* with the DNA constructs of Example 20 and the growth and propagation of transgenic *E. grandis* plants.

pARB373 (SEQ ID NO: 763) and pARB460 (SEQ ID NO: 762), as described in Example 20, were used to transform clonal *E. grandis* leaf explants. The leaf explants were transformed according to the protocol described in International patent publication WO00/12715, except where noted below. In brief, dissected leaf explants were inoculated with *Agrobacterium* comprising the DNA constructs pARB373 or pARB460. Inoculated explants were co-cultured for two weeks in diffuse light and selected on agar supplemented with 250 mg/L kanamycin and 250 mg/L timentin (omitting NAA from the transformation media). Leaf explants were then cultured for two weeks on on agar supplemented with 100 mg/L kanamycin and 250 mg/L timentin. The leaf explants were cultured for another two weeks on on agar supplemented with 150 mg/L kanamycin and 250 mg/L timentin. Thereafter and until healthy single shoots were collected, the leaf explants were transferred monthly to fresh media containing 150 mg/L kanamycin and 250 mg/L timentin.

Single shoots were place in elongation media in order to proliferate the putative transgenic tissue. The alongation media consists of Murashige and Skoog salts (MS) supplemented with 1 microM 6-benzylaminopurine (BAP), 20 g/L sucrose and 7 g/L agar. PCR analysis of the explant tissue was conducted after approximately 200 mg of tissue is grown and collected. Both the promoter and gene sequences were verified using PuRe Taq Ready-To-Go™ PCR beads (Amersham Biosciences, Piscataway, N.J.). PCR positive explants were then then maintained as sock cultures through proliferation on elongation media supplemented with 150 mg/L kanamycin and 250 mg/L timentin.

Transgenic *E. grandis* plants were propagated from these stock cultures. Where necessary, shoots were transferred monthly to fresh media. Single shoots were placed onto elongation media and maintained until reaching approximately 2-3 cm tall. Thereafter, single shots were placed into conventional rooting medium. After 10 days, the transformed plants are transferred to a green house with appropriate climate. A skilled artisan would recognize that many different culture media and intervals may be suited to regenerating plants of the instant invention. Using an appropriate humidity regime and fungicides to control fungal growth, transgenic plants were grown in the greenhouse for 6 months in potting mixture. In doing so, the transgenic plants were grown in a meshed compartment at ambient temperature with capillary watering. Plants were potted into 5 L poly-bags in s soil-less peat based compost supplemented with a slow release fertilizer.

A field test of pARB460-transformed *E. grandis* plants was established in Florida, USA in November 2003. This test comprised of about 20 different lines of pARB460-transformed *E. grandis* plants of about 8 ramets each.

Likewise, pARB373-transformed *E. grandis* plants were tested in Florida, USA in November 2003. This field test comprised of about 20 different lines of pARB373-transformed *E. grandis* plants of about 8 ramets each. A second planting of pARB373-transformed *E. grandis* plants was established in Florida, USA in May 2004. This test comprised of about 6 different lines of 2 ramets each. The same six translines and 4 ramets of each were also established in a field test in South Carolina, USA in May 2004.

Example 25

Example 25 demonstrates the testing of lignin content and other phenotypic traits in the transformed *E. grandis* plants of Example 24.

The transformed *E. grandis* plants of Example 24 were sampled at approximately 6 months of age. The bottom 20 cm of the stem was collected from each transformed plant. The bark, phloem and the primary cortex was removed from the stem by peeling. Stem samples were then flash frozen in liquid nitrogen, and freeze-dried in a Flexi-Dry Microprocessor Control—Corrosion Resistant Freeze-Drier (Stone Ridge, N.Y., USA) according to the manufacturer's instructions. Samples were ground in a Wiley Mill (Arthur H. Thomas Co,; Philadelphia, U.S.A) and then re-ground in a ring mill. Ground samples are then dried for a minimum of 1 day at 55° C. and stored at this temperature until used. Cell wall material was isolated from the samples in a series of stages by suspending the ground material in the solvent or solution, extracting with an ultrasonic cleaner, centrifuging and decanting off the supernatant. The following sequence of extractions was used: (1) NaCl at two concentrations; (2) aqueous ethanol; (3) CHCl$_3$:MeOH; and (4) acetone. To remove starch, the extracted cell wall materials were washed, heated in tris-acetate buffer to gelatinize the starch and then treated with α-amylase. Following enzyme treatment the suspensions were centrifuged and the resulting precipitate washed with ethanol and acetone, allowed to stand overnight, and then dried at 55° C. The isolated cell materials were used for small scale lignin determinations using the procedure described in Fukushima, R. S. and R. D. Hatfield, *J. Ag. Food Chem.* 49(7):3133-9 (2001).

Results from the Fukushima and Hatfield determinations of lignin content are shown in FIG. 229. As can be seen from FIG. 229, pARB373- and pARB460-transformed *E. grandis* plants have lignin content similar to plants transformed with the control DNA construct of Example 19.

Likewise, the height of pARB373-, pARB460-, and control construct-transformed *E. grandis* plants were compared. All measurements were taken on whole plants before sampling. The average heights and lignin content, as reported above, of pARB373-, pARB460-, and control construct-transformed plants are shown in FIG. 230.

Accordingly, even though lignin content is similar in each of the transformed plants, additional phenotypic changes, such as growth rate and average height, are effected by the modulation of monolignol synthesis genes.

Example 26

Example 26 demonstrates the analysis of lignin composition in the transformed *E. grandis* plants of Example 24.

Cell wall materials from the transformed *E. grandis* plants of Example 24 were isolated and prepared according to the methods described in Example 26. Once prepared, cell wall materials were analyzed for lignin composition using the DFRC technique as described by Lu, F. and J. Ralph, *J. Agric. Food Chem.* 45(7):2590-2592 (1997). Breifly, DFRC selectively and efficiently cleaves alpha-ether and beta-ether linkages to allow for the quantitative analysis of lignin subunits. The lignin-containing sample was dissolved in an acetyl bromide stock solution by gentle stirring at 50° C. for about 2 hours. Then, the volatile solvent and reagent were removed by rotary evaporation at less than about 40° C. with the addition of acetone. The residue was then dissolved in dioxane/acetic acid/water (5/4/1 by volume) After being stirred well, 50 to 100 mg of Zn dust is added. The resulting mixture was stirred continuously for 30 minutes and then extracted into methylene chloride to give a degradation product. These products were then acetylated with $Ac_2O$/pyridine (1:1) for about 40 minutes.

As determined by DFRC, the lignin composition of the cell wall materials are shown in FIG. 231. In this figure, the total lignin content and plant phenotype data obtained in Example 25 was compared to the lignin composition (expressed as the amount of syringyl and guaiacyl subunits in mmoles/g lignin) determined by DFRC analysis. The relative percentage of syringyl lignin from each sample was also shown. This percentage was determined by dividing the amount of syringyl lignin subunits by the total amount of lignin subunits. The data depicted in FIG. 231 is presented in order of increasing relative percentage of syringyl subunits.

As can be seen in FIG. 231, the pARB373- (SEQ ID NO: 763) and pARB460- (SEQ ID NO: 762) transformed plants possessed higher relative percentages of syringyl lignin subunits than control plants. Although in many cases plant heights were measured to be shorter than controls there were also cases where the height of the transgenics equals the controls and has higher syringyl lignin. When comparing transformed plants to the average of all the controls the largest increase in syringyl lignin is 31.3% although this transgenic also displays a decrease of 78 cm in height to the average of the controls.

In addition, FIG. 231 demonstrates that transformed plants can have an increase of 23.1% in syringyl lignin when compared to controls while maintaining no difference in height or total lignin amounts to the average of the controls. Increased in syringyl lignin in these transgenic plants also correlated with increases in the S/G ratio and the data from FIG. 231 combined with this figure show that plants transformed with pARB460 (SEQ ID NO: 762) can show increases in S/G ratios while still maintaining height growth not significantly different to control samples, while the average height of trees transformed with pARB460 is higher than those transformed with pARB373 (SEQ ID NO: 763).

Example 27

Example 27 demonstrates the transformation and propagation of *Pinus* plants.

The inventive DNA constructs were used to transform a *Pinus* plant. Any method known to those skilled in the art can be used. For example, specified clones of elite selected families of loblolly pine (*Pinus taeda*), and a particular clone of hybrid pine (*P. taeda×P. rigida*) can be initiated as embryogenic cell lines from zygotic embryos of individual immature megagametophytes using the procedures described in U.S. Pat. No. 5,856,191, and maintained using the procedures described in U.S. Pat. No. 5,506,136.

After one to three months of culture on maintenance medium, the tissue cultures were cryopreserved, stored for periods of up to several years, and retrieved using the methods of U.S. Pat. No. 6,682,931. Those skilled in the art of plant tissue culture will recognize that other cryopreservation and recovery protocols would be applicable to the present method and that the detail in this example may not be construed to limit the application of the method.

Uniform suspension cultures from each of the genetically different tissue culture lines were established by inoculating a 250 ml Nephelo sidearm flask (Kontes Chemistry and Life Sciences Products) with 1 g of tissue each according to the method of U.S. Pat. No. 5,491,090. The flasks containing the cells in liquid medium are placed on a gyrotory shaker at 100 rpm in a dark culture room at a temperature of 23° C.±2° C. One week later, the liquid in each flask was brought to 35 ml by pouring 15 ml fresh medium into the culture flask and swirling to evenly distribute the cells. Cell growth was measured in the sidearm by decanting cells and medium into the sidearm portion of the flasks, allowing the cells to settle for 30 minutes and then measuring the settled cell volume (SCV). When the SCV was greater than or equal to half the maximal SCV (50% of the volume of the flask was occupied by plant cells), each culture was transferred to a 500 ml sidearm flask containing a total of 80 ml cells and medium and the transferred culture was maintained under the same conditions.

To prepare for gene transfer, polyester membrane supports are sterilized by autoclaving and placed in separate sterile Buchner funnels, and for each of six replicate plates per cell line, one to three milliliters of pine embryogenic suspension was pipetted onto each support such that the embryogenic tissue is evenly distributed. The liquid medium was suctioned from the tissues and each support bearing the embryogenic tissue is placed on gelled preparation medium for *Agrobacterium* inoculation according to the methods described in U.S. Patent Publication No. 20020100083. Specifically, the binary constructs of SEQ ID: 757-761 were each introduced into different isolates *Agrobacterium tumefaciens* by techniques well known to those skilled in the art, and virulence was induced with administration of acetosyringone by commonly used techniques whereupon each of the induced *Agrobacterium* isolates was co-mingled with separate replicates of the plant material according to the methods described in U.S. Patent Publication No. 20020100083. Additionally, certain replicates of the plant material were co-mingled with *Agrobacterium* containing a mixture of equal amounts of the binary constructs of SEQ ID: 757-759 for contransformation. The cells were co-cultivated in the dark at 22°±2° C. for approximately 72 hours.

Following co-cultivation, *Agrobacterium* was eradicated from the cultures according to the methods described in U.S. Patent Publication No. 20020100083. Cells borne on polyester membrane supports were then transferred onto fresh selection media at intervals of 2 weeks. Active growth on the selection medium occurred in a number of isolated sectors on many of the petri dishes. Such active growth in the presence of selection agent was normally an indication that the growing tissues have integrated the selection gene into their chromosomes and are stably transformed. These areas of active growth are treated as independent transformation events and are henceforth referred to as putative transgenic sublines. The putatively transgenic embryogenic tissue was multiplied by transferring growing transgenic sectors to fresh semi-solid maintenance medium supplemented with the respective selection agent.

Putatively transformed sublines, after reaching approximately 2 g, were chosen for polymerase chain reaction (PCR) amplification for verification of the presence of transgenes using standard techniques. Lines that had been verified by PCR as co-transformed with any one, two, or three of the three constructs of SEQ ID 757-759 were selected for testing alongside lines transformed with the control construct of SEQ ID: 761 and the three-gene construct of SEQ ID 760, in order to verify the hypothesis that any production of syringyl pathway intermediates could be attributed only to the presence of all three genes, and to allow discovery of new intermediates that might be produced by any one gene or two-gene combination in the inventive gymnosperm cells or plants.

Germinable embryos were produced from each of the selected lines verified as transformed by PCR, as follows. After the cell masses cultured on selection medium have proliferated to at least one gram, each culture was separately resuspended in liquid medium. When the cell suspensions were brought to uniform (half-maximal) SCV, equivalent amounts of suspension culture cells were pipetted onto sterile membrane supports for placement on development/maturation medium as described in U.S. Pat. No. 5,506,136 to develop high quality harvestable stage 3 (cotyledonary) embryos. Dishes were incubated in a dark growth chamber at 23±2° C. The membrane supports were transferred to new petri dishes containing fresh medium every 3 weeks. At week 9, stage 3 (cotyledonary) embryos were visually analyzed for germination quality and harvested onto fabric supports on medium as described in U.S. Pat. No. 5,506,136, and incubated for about four weeks in the dark at a temperature of 4° C.±2° C. Next, embryos on their fabric supports were incubated above water in sealed containers for about three weeks in the dark at a temperature of 25° C.±2° C. Following the above two treatments, embryos on their fabric supports were transferred to medium germination medium and incubated for about three days in the dark at a temperature of 25° C.±2° C. Embryos were then removed from their fabric supports and placed onto the surface of fresh germination medium. Germination was conducted in the light at a temperature of 25° C.±2° C. Germination plates were examined weekly, over a period of about four weeks, and germinating embryos were transferred to MAGENTA® boxes containing 100 ml of germination medium for conversion to plantlets. MAGENTA® boxes containing developing plantlets were incubated in the light at 25° C.±2° C. for about eight to twelve weeks.

When the plantlets form epicotyls (newly formed shoots of approximately two to four cm), they were transferred to containers filled with a potting mix [2:1:2 peat:perlite:vermiculite, containing 602 g/m$^3$ OSMOCOTE fertilizer (18-6-12), 340 g/m$^3$ dolomitic lime and 78 g/m$^3$ MICRO-MAX micronutrient mixture (Sierra Chemical Co.)]. The plantlets were grown in a shaded greenhouse and misted infrequently for a period of about two weeks. They were removed from mist for acclimatization in the greenhouse for about four weeks. Plantlets were then transferred to outdoor shade for about six weeks for final acclimatization before moving to full-sun conditions. They were then grown in containers until conditions were ready for field planting.

Once transformed and propagated, a skilled artisan would also recognize the accelerated reproduction of *Pinus* plants can occur by grafting of the plantlets. See, e.g., Mergen, F. (1954) Rooting and grafting of slash pine (*Pinus elliottii* Engel.) for application in forest genetics. Ph.D. dissertation, Yale University, New Haven, Conn.; and Ahlgren, C. E. (1967) A relationship between scion, bud origin and growth of white pine grafts. *Minnesota Forestry Notes* 180. University of Minnesota, St. Paul. 2 p.

Example 28

Example 28 demonstrates histologic staining of the tramsformed *P. taeda* plants of Example 27.

Samples were taken from 8 month-old *P. taeda* plants were transformed and propagated as described in Example 27. One plant was transformed with a DNA construct comprising SEQ ID NO: 760. Another plant co-transformed with DNA construct comprising SEQ ID NOs: 757-759. Another plant co-transformed with DNA construct comprising SEQ ID NOs: 757 and 759. In addition, control *P. taeda* trees or *Populus deltoides* (cottonwood) trees about 6 months old were sampled. Samples were taken from the lower stem of the plants, and sectioned with a Uchida sliding sledge microtome (EM Scientific) to obtain sections approximately 40 μm thick. Sections were then stained with toluidine blue, phloroglucinol (1,3,5-trideoxybenzene; FW=126.1), and Maule and stains.

Toluidine blue is a general cellular stain used to assist in the delineation of cell types such as parenchyma, xylem and phloem in the cross sections. Phloroglucinol, also known as the Weisner reagent, is a stain for lignin (Pomar et al., *Protoplasma*. 220(1-2):17-28 (2002)), and Maule stain is used to detect specifically syringyl lignin subunits (Lewis et al., *Annu. Rev. Plant Physiol. Plant Mol. Biol.* 41: 455-496 (1990)).

To stain sections with toluidine blue, sections were placed in 50 mM Tris-HCL pH 8.0 as soon as they were cut until all the sections were collected. The Tris buffer was replaced with enough 0.05% aqueous toluidine blue and left for 1 minute. The sections were then rinsed with water before images were captured with a Spot RT Color Camera under a Wild Heerburgg dissecting microscope.

To stain sections with phloroglucinol, sections were placed in 50 mM Tris-HCL pH 8.0 as soon as they were cut until all the sections were collected. The Tris buffer was then replaced with 1% (w/v) phologlucinol and the sections stained for 15 minutes before images were captured with a Spot RT Color Camera (Diagnostics Instruments) under a Wild Heerburgg dissecting microscope (Iiyama et al., *Wood Sci. Technol.* 22:167-175 (1988))).

To stain sections with Maule, sections were placed in 50 mM Tris-HCL pH 8.0 as soon as they were cut until all the sections were collected. The Tris buffer was replaced with enough 1% (w/v) $KMnO_4$ to completely wet all the sections and incubated at room temperature for 5 minutes. The sections were rinsed with 10 volumes of water and then covered with enough 3% (v/v) HCl to wet the sections. This was left at room temperature for 10 minutes and then replaced with enough $NH_4OH$ to completely wet the tissue. After a minimum of 2 minutes the sections were mounted in water and images were captured immediately with a Spot RT Color Camera under a Wild Heerburgg dissecting microscope and rated on a scale of 1 to 5 for brightness of stain (Speer E. O., *Stain Technol.* 62(4):279-280 (1987)).

Staining of each blind-labeled sample was rated for intensity by three independent observers. The results are compiled in FIG. 232 for all the assessed sections stained with Maule reagent. Maule staining is specific for syringyl lignin and staining results of controls are consistent with this. Cottonwood is a hardwood high in syringyl lignin (Li et al., *Proc. Natl. Acad. Sci. U.S.A.* 100(8):4939-4944 (2003)) and syringyl lignin is not normally found in gymnosperms. Accordingly, Maule staining was heavy in the cottonwood sample sections and was not observed in the pine control sample sections. In sections of the wood of regenerated *P. taeda* transformed with the inventive constructs, Maule staining consistent with the presence of syringyl lignin was observed (FIG. 232). The highest and most consistent staining was observed in trees transformed with SEQ ID NO: 760 where the average of all the lines stained was measured to be at least a 3 on a scale of 0 to 5. Maule staining was observed in all the lines co-transformed with SEQ ID NOs: 757-759 but the results varied to a greater degree when compared to lines transformed with SEQ ID NO: 760. Five of the 9 lines co-transformed with SEQ ID NOs: 757 and 759 showed a little staining with Maule while the other 4 lines showed no staining. These results indicate that co-transforming *P. taeda* trees with SEQ ID NOs: 757 and 759, co-transforming *P. taeda* trees with SEQ ID NOs: 757, 758 and 759 or transforming *P. taeda* trees with SEQ ID NO: 760 can lead to the presence of compounds that stain with Maule reagent in those trees, although the stain is faint in many of the lines co-transformed with SEQ ID NOs: 757 and 759. However, additional experimentation was needed to determine whether these are soluble compounds such as unincorporated sinapyl alchohol or intermediates or lignans, which do not contribute to production of syringyl lignin in the cell walls, or whether syringyl lignin monomers are being incorporated into cell wall lignin.

Accordingly, the samples were further examined. Next, stem sections were either directly stained with phloroglucinol or Maule as described above or pre-treated for extensive extraction of soluble compounds before staining. Pre-treatment involved placing stem sections in a microfuge tube with 80% ethanol, floating the tubes in a Branson 1510 sonicator and sonicating the samples for 30 minutes with ethanol changes every 10 minutes.

One positive staining sample from each set of trees transformed with either SEQ ID NO: 760 or co-transformed with SEQ ID NOs: 757, 758 and 759, a negative staining sample transformed with SEQ ID NO: 761 and an untransformed *Eucalyptus grandis* seedling stem section, which should show the heavy Maule staining typical of an angiosperm (use in this experiment because the age of the wood was comparable to that of the pine transformants, while the cottonwood control that had been used in the initial exploratory experiment described above was older) were stained both with and without an ethanol-sonication extraction pretreatment. The sections were rated on a semi-quantitative scale of – to +++ for intensity of staining and the results are listed in TABLE 21.

TABLE 21

| SEQ ID | Maule | Maule + pretreatment | Phloroglucinol | Phloroglucin + pretreatment |
|---|---|---|---|---|
| 760 | +++ | +++ | +++ | +++ |
| 757, 758 & 759 | + | + | +++ | +++ |
| 761 | – | – | +++ | +++ |
| E. grandis | +++ | +++ | +++ | +++ |

If the compounds stained in the previous experiment using Maule or phloroglucinol were in fact soluble lignins in the cytosol a skilled artisan would have expected a substantial difference in staining intensity between the samples that were pre-treated and those that were not pre-treated. Since no difference was observed between pre-extracting the wood of pine samples and not pre-extracting the wood of pine samples in which all three genes were added by transformation, those skilled in the art would assume that the compounds produced in the stained three-gene transformant plants are not soluble and thus likely to be incorporated into the cell wall. The staining observed in this example is consistent with that observed in the pyrolysis molecular beam mass spectrometry results of Example 29 with plants co-transformed with SEQ ID NOs: 757, 758 and 759 not producing as much syringyl lignin as those transformed with SEQ ID NO: 760. Both these examples strongly support the claim that the enzyme produced by the gene of SEQ ID NO: 758 has a sinapylaldehyde dehydrogenase function which, in combination with a Cald5H enzyme and an OMT enzyme added by transformation to a gymnosperm, can produce syringyl lignin monomers that are incorporated into the wood cell walls.

Example 29

Example 29 demonstrates the analysis of plant lignin composition by pyrolysis molecular beam mass spectrometry.

Loblolly pine trees were' transformation and propagation as described in Example 27. Samples were collected from the same transformed plants as described in Example 28 at 4 months. In addition, samples were obtained from a loblolly pine untransformed control and a mature aspen untransformed control. All samples were obtained by cutting approximately 20 mg of tissue from each stem. Each sample was weighed in a quartz boat, and pyrolyzed in a reactor consisting of a quartz tube (2.5 cm inside diameter) with helium flowing through at 5 L/min (at STP). The reactor tube was placed such that the sampling orifice of the molecular-beam mass spectrometer was inside the end of the quartz reactor. A custom-built molecular-beam mass spectrometer using a Extrel™ Model TQMS C50 mass spectrometer was used for pyrolysis vapor analysis as described in R. J. Evans and T. A. Milne, *Energy & Fuels* 1:123-37 (1987), and J. C. del Rio et. al., (2001) *J. Anal. Appl. Pyrolysis* 58-59:425-439 (2001). The reactor was electrically heated and its temperature maintained at 550° C. Total pyrolysis time was 90 seconds although the pyrolysis reaction was completed in less than 50 seconds. The residence time of the pyrolysis vapors in the reactor pyrolysis zone has been estimated to be ~75 ms and is short enough that secondary cracking reactions in the quartz reactor are minimal. Mass spectral data from 20-450 Da were acquired on a Teknivent Vector 2™ data acquisition system using 22 eV electron impact ionization. Using this system, both light gases and heavy tars are sampled simultaneously and in real time. The mass spectrum of the pyrolysis vapor provides a rapid, semiquantitative depiction of the molecular fragments.

Duplicate mass spectra of the loblolly pine sample set and standards were collected on 2 successive days in a block fashion so as to mitigate problems associated with data analysis that could arise from day to day spectrometer drift. A combined analysis of the mass spectra collected on both days indicated that minimal spectrometer drift occurred.

Spectra from each of the samples were examined. Particular attention was given to the peaks arising from the pyrolysis of lignin break-down products. The assignment of mass spectra peaks associated with pyrolysis molecular beam mass spectroscopy of loblolly pine wood samples was described in Evans & Milne (1987) and those assigned to lignin break-down products and monomers are listed in TABLE 22.

TABLE 22

| m/z | Assignment |
|---|---|
| 124 | guaiacol[3] |
| 150 | vinylguaiacol[3] |
| 154 | syrignol[2] |
| 164 | propenyl guaiacol[2] |
| 168 | 4-methyl-2,6-dimethoxyphenol[2] |
| 194 | 4-prophenylsyringol[2] |
| 210 | Sinapylalcohol[2] |
| 285[1] | Dehydroabietic acid[3] |
| 302 | abietic acid[3] |

NOTES: [1]fragment ion, [2]syringyl monomer, [3]guaiacyl monomer

As can be seen in FIG. 233, the average intensity of peaks relating to lignin break-down products for each of the controls and transgenics was recorded. Syringyl lignin and its break-down products are not usually observed in pine. Accordingly, a skilled artisan would conclude that low noise levels of the syringyl lignin break-down products are observed using this method. Mature aspen was used as a positive control so as to confirm the identity of each of the peaks as it is known that aspen has very high amounts of syringyl lignin at maturity (Li et. al., *Proc. Natl. Acad. Sci. U.S.A.* (8):4939-4944 (2003)). Trees co-transformed with SEQ ID NOs: 757-759 or transformed with SEQ ID NO: 760 did show increases in some of the syringyl lignin break-down products. When comparing the highest measured result for trees transformed with SEQ ID NO: 761 (GUS controls) to trees transformed with syringyl lignin vectors the most evident increases were observed with the syringyl break-down products syringol and sinapylalcohol. There was up to a 95.5% increase in syringol in trees transformed with SEQ ID NO: 760 and up to a 74% increase of syringol in trees co-transformed with Seq ID NOs: 757-759. As can be seen in TABLE 23, there was also up to a 99% increase of sinapylalcohol in trees transformed with SEQ ID NO: 760 and up to 45% increase in trees co-transformed with SEQ ID NOs: 757-759.

TABLE 23

| SEQ ID NO | Guaicol | vinylguaicol | propenyl guaicol | syringol | 4-methyl-2,6-dimetoxyphenol | 4-propehylsyringol | sinapylalcohol | dehydroabietic acid | abietic acid |
|---|---|---|---|---|---|---|---|---|---|
| 760 | −7.45 | −1.95 | −0.32 | 95.54 | 57.14 | 47.69 | 99.00 | 12.49 | 12.94 |
| 757, 758 and 759 | 1.92 | 0.02 | 6.03 | 73.96 | 3.10 | 44.27 | 45.22 | −5.62 | −13.90 |

A skilled artisan would conclude that increases in some of the syringyl breakdown products are observed in plants transformed with SEQ ID NO: 760 or co-transformed with Seq ID NOs: 757-759. The observed increases in syringyl breakdown products were greater when the genes used in SEQ ID NOs: 757-759 are not co-transformed into a tree but transformed as a single vector as in SEQ ID NO: 760. These measured increases in syringyl lignin breakdown products in plants transformed with syringyl lignin vectors suggest that more syringyl lignin was formed in transformed plants than in controls, but these measurements do not reveal if the increased syringyl lignin had been incorporated into the cell wall.

Example 30

Example 30 demonstrates use of transformed *Pinus* plants to increase pulping efficiency in the commercial wood pulping and papermaking industry.

Wood possessing increased percentages of syringyl subunits has been shown to have increased pulping efficiency. See Huntley et al., *J. Agric. Food Chem.* 51(21):6178-6183 (2003). *Pinus* plants transformed with the inventive DNA, and more particularly SEQ ID NOs: 185-186 or 762-763, can also produce wood with increased pulping efficiency.

To determine whether reduced lignin content or altered lignin composition correlates to improvements in the pulping process, the inventive transformed plants are subjected to micro-pulping. Micro-pulping can be used to assess parameters for the determination of the suitability of wood for Kraft pulping. These parameters are pulp yield, pulping rate, alkali consumption, fibre qualities and pulp bleachability. For the inventive plants, these parameters are tested as follows.

Wood samples are air dried, chipped and then oven dried at 105° C. for at least two days and until a constant weight is reached. Kraft pulping is performed in 150 mL stainless steel reactors attached to the rotating arm of a Stalsvets multi-digester pulping unit (Stålsvets, Sweden). The reactors are rotated through a polyethylene bath heated by electric heaters having a total capacity of 12.5 kW and controlled by an Omron controller (Omron Corporation, Illinois, USA) Typical pulping conditions are:

Effective alkali charge: 14% (as $Na_2O$)
Liquor sulphidity: 30%
Liquor:wood ratio: 6:1
Maximum pulping temperature: 170° C.
Time to maximum temperature: 90 minutes
H-factor: Determined by varying the time at 170° C.

Those skilled in the art of pulp manufacture will recognize that many other combinations of micropulping conditions are available to test the pulpability of the inventive wood. Subsequently, the reactors are quenched in cold water, and the cooked chips filtered off on a Buchner funnel. The filtrate is retained for residual alkali analysis. The cooked chips are washed extensively with tap water and then blended for 15 minutes in a standard British disintegrator. The resulting pulp is filtered on a Buchner funnel and washed with water until the filtrate is clear. The pulp pad is dried overnight at 60° C., and total yield determined by weighing.

Residual alkali is determined by titration with 0.5 M hydrochloric acid to the first inflection point. See Milanova et al., *Nordic Pulp and Paper Research Jl.* 9(1):4-9 (1994). Alkali consumption is generally understood to be the difference between the effective alkali charge on chips and residual alkali in the black liquor, expressed as a percentage of oven-dry chips (as $Na_2O$).

Pulp kappa number is determined by a half scale modification of Appita Standard 201m-86 (AS/NZS 1301.201s: 2002). The pulping rate is calculated as the kappa number reached for a given cooking time.

Pulp bleachability is determined by bleaching pulps at 10% consistency using a D-Eo-D sequence (see Kibblewhite et al., *Appita* 51(2):1145-1121 (1998)) as follows:

D stage: 0.25 active chlorine multiple, 100% industrial chlorine dioxide, 50° C., 60 minutes.

Eo stage: 2% NaOH, 0.25 mPa $O_2$, 70° C., 60 minutes.

D stage: 1% $ClO_2$, 70° C., 180 minutes.

Following bleaching, 5 g brightness pads are prepared at about pH 4.0 to 5.5, and brightness is determined after equilibration at 23° C. and 50% RH using a L & W Elrepho (Lorentzen & Wettre, Kista, Sweden). Fiber qualities such as average fiber length, width, and lumen size and standard deviations are analysed using a Kajaani FibreLab system (Metso Automation, Kajaani, Finland).

The results are correlated to the type of construct used in the transformation and demonstrate that the constructs effectively modulate the suitability of the wood resources for Kraft pulping While the invention is described with reference to exemplary embodiments, it will be understood by those skilled in the art that various changes may be made and equivalents may be substituted for elements thereof without departing from the scope of the invention. In addition, many modifications may be made to adapt a particular situation or material to the teachings of the invention without departing from the essential scope thereof. Therefore, it is intended that the invention not be limited to the particular embodiment disclosed as the best mode contemplated for carrying out this invention. All references and publications cited herein are incorporated by reference in their entireties.

Lengthy table referenced here

US07799906-20100921-T00001

Please refer to the end of the specification for access instructions.

Lengthy table referenced here

US07799906-20100921-T00002

Please refer to the end of the specification for access instructions.

Lengthy table referenced here

US07799906-20100921-T00003

Please refer to the end of the specification for access instructions.

Lengthy table referenced here

US07799906-20100921-T00004

Please refer to the end of the specification for access instructions.

Lengthy table referenced here

US07799906-20100921-T00005

Please refer to the end of the specification for access instructions.

Lengthy table referenced here

US07799906-20100921-T00006

Please refer to the end of the specification for access instructions.

Lengthy table referenced here

US07799906-20100921-T00007

Please refer to the end of the specification for access instructions.

Lengthy table referenced here

US07799906-20100921-T00008

Please refer to the end of the specification for access instructions.

Lengthy table referenced here

US07799906-20100921-T00009

Please refer to the end of the specification for access instructions.

Lengthy table referenced here

US07799906-20100921-T00010

Please refer to the end of the specification for access instructions.

Lengthy table referenced here

US07799906-20100921-T00011

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US07799906B1). An electronic copy of the table will also be available from the USPTO upon request and payment of the fee set forth in 37 CFR 1.19(b)(3).

SEQUENCE LISTING (819 sequences)

SEQ ID NO: 1 - DNA, 1434 bp, Pinus radiata
agatctgctctgtcctttttaacagattcatctcaactttcttgttccactgtcaacattttctcaactgctctgccccatctttattaaaagggaacatctaccctgcatttccacactccaatcactcttccccctcttgaagctttacatgctgtttgctcttcagcttctttttacttggattcaaaaattaagcttcccacagttgtctactgttcacttcttgtatctgttaacctcttgctctgagagttgcattctgtagtttgaaaaaaaacatggaatcagatgaaatgaaggaggacaagaaaacagataaaatagtttgtgtcacaggagcaggaggattcattggctcatggcttgtcaagcagctccttgccaaaggatatactgtaagaggagcagttcacagcaacccagctgatgatgggcgtaagtatgagcatttaagagagctggaaggagcaaaagagaggcttgagattgttaaagctgatattctcgattaccaggctttggtcacagttatccgaggctgtcacggtgttttccacacagcttgtcttataagtaatgaccctgagcgagttatagatccagcagtgagcggaaccaggaatgttctggaggcgtgtgcggaaatgggagtgaagcgcgtggtagttacatcttctatcggtgcggtttacatggatcctcacagagactcactcgccatagtcgatgatgaatgttggagcgatttggactactgcaaacaaactaagaattggtattgctatgcaagatcttggcagagaagttggcatgggagattgccgagaaaaggaatttggacattgcagtggttattccgtgcctggttttaggtcctatgttgcagcccaccatgaacatgagcaattttcatattatgaaatacctgaaagggtcaaccaagacatataaaaatttaactcaggcatatgtggatgtgagggacgtggcagaggctcacattttggtgtatgaaaagccttcagccagtggccagaggtatctgtgtgcagaatcgaacctccacagaggagatctgactcacatgttggctgaattgttcccacactatccaattcctacaaagtgttcagacgaagaaaacccaagaaagcagccatacaagttttccaatcagaagctcagagatttgggcctgtccttcacccccatgaagaagtgtttggccgatacagtggcctgcttacagaagaagggctttattcaatagattctacaagctttaatcctctgaaatatgcgatatacaacacttagttgtttggtactgatagtaacatggctgaccatcttgcggtgaggaaacatattttcaatttattttatggccatgaaatttatataatttttcattatatttcaaaaaaaaaa

SEQ ID NO: 2 - DNA, 1494 bp, Pinus radiata
gtcggggtcaatggcggagttgtacggtgggattgggttccacagcttattgttgccattaattgtactcattgtagcctttccctgtattattctgttctcttgaaacgcttcaaccgttgctgtgatatcgaaattccatagctatgagtgggagactggtctgcgttacaggagcctcgggattcatcgcctcatggctggtgaagttgctgttggatcgtggttatgtagttcgagctacccttcgtgatataggtaatcctcagaagacagaacacttgcgtgcattggaaggagccaatgaaaggcttcaactggtgaaagcaaatttacttgatgagggaacttttgatgcagctgtggatggttgtgaaggtgtctttcacactgcatcacctttttacttgggcgtcaaagatccccagactgaaatgcttgatccagcagttaaaggcactcttaatgttcttaatgcatgtgccaaagcttcttcgataaagagggtggtagtaacatcatcagtagcagctgtcatatacaattttaggcctcgatcacctgatacagtagttgatgaaacttggttcagtgatgtagagtactgcaagcaagctaaggcctggtatcagctatcaaagacattggcagaagaaactgcatggaaatttgcaaaggaaaggggtatcgatcttgtcacaataaatccagctatggtgattggcaggcttctacaacctactctgaatacaagctgtgctgccattctacaattaatgaatgggtcttcgacatttccaaatatgacatttggatgggtgagtgtgaaggatgttgcagaggcacatattctagcatttgaagttccgtcagcaaatggaagatatcttttagctgagaaggttgctcactactcagaaattgtgaagatcctgagtaaactatatccaggctgcacgctcccaacaaagtgtgttgatgataatccctttgcccctacctttactgtatcaaaagaaaggatagagaagttgggtctgaagtacactcctattgaagaggctctcagagatactgttgaaagcttgaaggaaaagaagttgcttaacttagacagcaatctgtgatttatcaatacctggaaacctttttgtttttaaatatatgtcgttgggcatgcatctagctgttattttgttggaaatgagcttcatcttctgtcaagcacagcaatgtccttgaaagtcaaacatgtcctttgcctactttatttttggataatttttcaaaaacattttgaatgaataaacttaatattcttagctgtttgtttactgggcaacagccgaagtatatcaacatagatatagatgtttagggagtcaaaaaaatgtattgatgatagaggtttactggttggttcaaccttagtagtcctctatttccttctaatggcatcaagaaaatagttatttttttcctggaaaaaaaaaa

SEQ ID NO: 3 - DNA, 1442 bp, Pinus radiata
gttgggaaatgggaaacggagttctagtgaaaacagaattctagtgcggatttggttccgacttttattctcgtcattaatcgttctcattgtagcctacctttctgtaaaaccctcgtaacacacattggtctgattatcctattctccgaaaacgcttcgatccttgctgtgatatccaatttcgataaaccatgagcgggagactagtctgcgttacaggagcctcggggttcatcgcgtcatggttggtgaagttgctgctggatcgcggttatgtagttcgagctaccgttcgtgatttaggtaatcctgagaagacaaagcacctacatgtattggaaggagcaaaagaaaggcttcaactggtgaaagcaaatttacttgaggagggaacatttgatgcagctgtggatggctgtgaaggtgtctttcatactgcatcaccattttacactagcatcaaagatccccaggctgaaatgcttgatccagcagtcaaggggactactaatgttcttaatgcatgtgccaaagcttcttctgtgaagagggtgatagtaacctcatctgtggcagctgttatattcaattctaggcctcgatcacctggagtagttgatgaaacttggttcagtgatgcagagtactgcaagcaaactaaggcctggtaccagctatcaaagacattggcagaagaaactgcatggaaatttgcaaaggagaagggtattgatgttgtcacaataaatccagcgatggtgattggcacacttttacagcctactctgaatacaagctgtgctgcaattctacaaataatgaatgggtcttcaacatatcctaatgcgacgtttggatgggtcagtgtgaaggatgtagcaaatgcacatattctagcatttgaagttccatcagcaaatggaagatatcttttggttgagagggttgcccacttatcagaaattgtgaagatcctgagcaaactatatccaggctgcgcacttccaacaaagtgtgcagatgataatcccttcgtccctacctatactgtctcaaaagaaaagatagagaagttgggtctaaactacactcctattgaagaggctctcagagataccgttgaaagcttgaaggaaaagaagttgctcaacttagatagcaatctgtgatttgcttatacctggaatcctttttgcttttaaatatgtggttatgccacttagcttttatttaaaattctgttggaaattagattcatcttctatcaaacacggaaatgtccttgaaagttagacatgttctttacctattttatttttggatcatttttgaaaacatttaggatgaatgtaacttcattattcttagctgttatatttattgggaaacggttgaagtaatatcaatatagatatagtgtgtagagcccaaaaaaaaaa

SEQ ID NO: 4 - DNA, 1230 bp, Pinus radiata
ctgaaacgggggaattcctgatagggtaaagtaaacctgcaaggggaattcctgatagggtaaagtaaacctgcaaatttgggtgcaggatttgcagaggtctggtctggtctgaaaatgggggaatcggtgtgtgtaacgggagccagtggattcattggatcgtgggttgttcgtttgttgttggaacgtggttattctgtgcatgccaccgttcaagatcttggaaactggaaggagactaagcatctagaggcaatggaaggagcaaaagagaggctgaagttatttaaaatggatttgatggattattcgtctatccaagatgccattgatggttgtgctggtgtttttcatttagccatgcccaatactattgacgcagttgcagatccccaaaagcaactgctggatccaggcattaaggggacaataaacgtgctggaagcagctcacaaagccaaagtgaggcgtgtggtgttgacctcttcgatttctgccataattccaaaccccaaatggcctgcaggcaagcctttggatgagaactgctggacagatctagattactgcagagagaatggaatttggtatacagttgcaaaaacattggctgaaaaggcagcttgggaattttccaaggagaagggtttggatgtagttgccataaaccgggggactgccttggggccgatcttgccacctgagatgaatgccagcctggccatgatcgtcaaactccttcaagggagcaatgaagaatatcgaaatttttttatgggttgtgcacatgtaaagggatattgcgaaagcccaaatactactattgaaacaccttcagcctctgggaggcacctttgtgttgagactatagcccattggagcgatttcgctgacttgactgcaaaactatatccagaatataatgtgcacaagtttacaagtgtcacacaaccaggtttggtacgcgttgggaatccaccaaaaaaattatctgaccttgggcttcaattcacatcgatggaacagataattaaagattgtgtttccacactgcgtgagaaaggccttttggtttagtgagcatagaataggcaaatgttttcctagataattttcagtatagaactttgtttatgcctactaaacatttttggtaagttttaagctataaaaattacatgatatcatctaatgattgatgagttctttaaaaaaaaaaaaaaaaaa

SEQ ID NO: 5 - DNA, 1380 bp, Pinus radiata
ggggaaaattccaaaatcaataacgagaggacagaagtaagtttgtggaaatagcaaccatgccggtgtttccttctggtctggacccctctgaggacaatggcaagctcgtttgtgtcatggatgcgtccagttatgtaggtttgtggattgttcagggccttcttcaacgaggctattcagtgcatgccacggtgcagagagacgctggcgaggttgagtctctcagaaaattgcatggggatcgattgcagatcttctatgcagatgtcttggattatcacagcattactgatgcgctcaagggctgttctggtctgttctatacctttgagcaccctcagagtgctgcaggctatgatgaagtgatggcagaaattgaagtacaagcagcccacaatgcactggaagcgtgtgctcagactgagaccattgagaaagttgtgttcacttcttctgtggctgcagcaatttggagagaagatggagactacaaggttaatgcccttgacgagaggcattggagtgatgcaaatctttgcaggaaattgaagttgtggtacgcattagccaagacactgtcagagaaggctgcatgggcgctggcaatggacagagggttgaatatggtgacaatcaacgcatctctgattgtaggacctggcatcacatacaaaagctcaggatctaccattgcatatcttaaaggggctgcacaaatgtatgagaagggcactttagctagtgtggacataaggtttctagcggatgcacatatatgcgcttatgaagatccatctgcctatgggaggtatatttgtttcaatcaaatagtcagtaatgcagaggatgctgtcaatttagcacagagcttgcgtcacctgataccgttccctgatagatttgaagactcaacggtctaccaacagcgtctgagtaataagaagttgactggattgatggttggatatggaaatcgtgcaaccctaagcagcgaactgtaacgggggaggagggcttttccccatgtttacagatcatcagcagccatgaatgaggggcacaagaaaacttggggagcttacatcttcagactacatccattattgtacatcatgtaatataattttcacttttaggttcgttggaatgttggcaataagtcgatttccttcccgacgagcattaaagtctcaaccttcatttgatagttggcaacagcacatttccataacgaccagcattgaagttttagcctgtcactaaggctctcaaccatacgcatttttttgttaattgctgaagtaaaatctatttcctgatttcttgcaaaagtgcaagcaagctttgtggatgggctgtttggtgtgtgaataaaaa

SEQ ID NO: 6 - DNA, 1659 bp, Pinus radiata
ggacactcctgtcttgaggaggactgagattcctctcttcataagtgtgctcaagaccagttttgagtgccctgttttatgtaataattctcacaattaatatacaaatgaattatatcaaagcagagcttgaagctctgtcttctctgatatcgcttcattccatcatccaggagcttctgttatatccatttcctcaaaatggatgcctaccttgaagaaaatggatacggcgcttccaattctcggaaattaatgtgccttaccgggggctggagtttcctggggattcatatcgcaagaatgctgctcggccggggttactcagtccgtttcgcaattccggtaacgccagaagaggcaggctcacttatggaatccgaagaagcattatcggggaagctggagatatgccaagccgatctcttggattatcgcagcgttttcggcaacatcaatggttgctccggagtcttccacgtccctgcgccctgtgatcatctggatggattacaggagtatccgactgatagcatagactacgaggttcaaagcgcgttgaatgtggtggaagcctgcgctgccgcagagagtgtgaagcgtttggtgttcacttcctctgtatcggccattgtttgtgggaggaggactggcaatctgggcgatggtgaaattatggacgagaagtgctggaccaatcctgaattttgtcgtgaaaagaagttgtggtcgccattggcaaagactctttcagagaaagctgtatgggcactctcaaatgacagggaccttaatctagtagtagtgaatcctgcttcagtcattgggccccaactctcaaatcctaattcacataccattttaaaccaattgaaaggatcgaaggcactacagcagaatggtatttctgctatctgtgcatatgtagatgtggaagaagcggctcttgcacatgttgctgcctttgaatgtgaaaatgcaacaggcagatacatatgtttgcagagggtctttacagaagatgaaataaaagaagttatgtggagctctcacatgacatcaaattacaggctggagagtttgttgcatcctgagaagccactgaacctttccaacgagaagtttttaaagttgaaaaggcaatattctggagagctggcatagttgcacctacctctgatctgtggtggtcaagtcacgatatatataagcaaccaaccaagtttagatgaaagaaataaaaaataggaatagtactttagtatcaatatatctatgacatatttctaattttccccttattctagaggggaagataaatctcattaatgtagttatctttaccttacctggaagataaatctcattaatgtagttatctttaccttgacctttcatatcgatatggccttttcttcttccagcgggccacttagcttcttccaatgggtcacttatcttctggtcaggaaggggttcaattatggctttatttagccttcatgtagtttctatatatacattttattattaattggtttattttcttccaatgggtcacttatcttctggtcaggaagcgattcaattatggctttatttagctttcatgtagttctacatatacattttattattaatttctttataaaaaaaaaa

SEQ ID NO: 7 - DNA, 1426 bp, Pinus radiata
gttcggccgttttgaaggttagatgtggcgctcccccaactactcgtccatgtcattcatccccttttcgtttcaaataaattagagccaccggggagattcttaactgtcaactctgccttggagcttgcactgctgttctgccatggcgatcgtgaagactgcacccatctgcccaggccaccatgactggaaccgattgcccaaggagatcaaaccagacaccttcagatcttcatcacccaagaccaagatggtctgtgtcacaaatgggacttcctttcttggtctctggattgtcagacagttgctgctcagaggatacatggttcgggtcactgtccataatacaggggaattgcagagggtgggagagatggaggagtttgccttgtactcagccaacaataaactcactggtgtggtggcaaatgtggtctctgattctactgctgctctctgtgaagcttttgatgggtgttatggggtgtttcatacatcttccttcattgatccacatggtctttctggatacacagagcatatggtgaatttagaagtgaaaggggcagaaaaaacagtggaagcatgctgcatgacctcctctgtgaggaggtgtgtgttcacatcttcattgactgcctgtgtttggcaacgttatggattcaatgaggattgtgaatttgttgtggatgaaaaatgctggagtgatcagcacctttgcagggaaaagaagctctggcttgccctgtcaaagaccatgtccgagaaagctgcctggagagttgcagaagaaaggggaggcgtgaatttggtgaccctttgtcccgccctattaacggggcctgcgttttctgcatcttgcgcctcatccgctgttgcttatctcaaaggtgccagagagatgtacgagaggaatctgctggcgacagtggacgtaaggagggcagcagaggctcacgtctgtgtgtatgaagagatggagattgggggcagtggaagatatatttgctttgataaggtcataaccaggcctgaggatgccagagatttggagaagaaactcaatatgggattgggtttttctgcagatgagaattctgaagagaacagatcgtctcagtatcatatcggatctcatcggattttcaatgccaagttgaggcgaatcctggatctgtcagcttctggccggtcctgcaggcgtgagagtgagtgaggaaagtctgaaaagtaggctaaaatctaattggccatgttctctgagaaatcaatatgttcagatccagcacatgcatggcttgaatgaggatgtacagaaaatactttaaatagttctcatgtcagagagtacagaagtcatgatatgagattttggtttagttttacagtgcaaatccttatggagatgtgatgcaaatcatgg

SEQ ID NO: 8 - DNA, 1372 bp, Pinus radiata
gtaagatcagtgtcaggacttgagcggaagtgtttcaatttttttgatcatttcaaggcaggtacttaccagtgtgaaaatgggtagcaaagaaactgtatgtgtgaccggagctagtggattcatcgggtcatgggttgttcgtttgttgctagaacgaggctactctgtgcggggaactgttcaagatctcggaaatgagaaggagactaggcacttagaggccatggaaggagccaaggagagactggaattgtttcaaatagacctgctggattatggttctatcgagactgccattaatgggtctgttggtgttttccatttagcgtctccttgtattgtcgaagaagtcaagaacccacaagcccagcttttggatcctgcagttaagggtaccatgcatgtcttgcaagcagcgcagaaagccaaagtgaaacgtctggtgttaacctcctcaatctctgcaattattccgagtccgaactggcctgcagatttaccgaaggatgagaactgttggactgatcttgattactgcaaagaaaatgggatttggtatcctgcatcaaaaacactcgctgaaaaagcagcttgggattttgccaaagagactggtttggatgtggttgttatcaatccaggaactgtgatgggaccgattctgcctccggccatcaatgctagtatggccatgtttcttcagcttcttcaaggtggcacagaaggatatcagaatttttacatgggctgtgtacatgtaaaagatgttgcggaaggacatatattactatatgaaaccccatcagcatcaggaaggcacctttgtgttgaagcaacaaaccattggagtgactttgctgagatggtggcaaaactataccctgaatataaaatacacaggttcactgaagtgacacaacctggtttgttacgagttcagagtcctccaaagaaacttgttgacctgggcctcgtttttacacccatggagcaagtaattaaagactcagtttctagtttaaatgaaaaaggctttttgaattgaataatgaccatctttgtatgatcagatcttattacagtggaaacgaagaccatatgacttcctaaccatctggaaaaggaaatatttctgaattagttgatgctgacctgctgaatgacgttccccattttctattctatatacccacttgtgcaaagtagataccatcctgttccgctgaattgaagtacattttcaaaatgcgctactatgacattttataggatgtctgagtgtaaaataatggtactggttgttgcaaagaatctgatgtttggatgtatggaactataaatagatgttattttctgatcaaaaaaaaaa

SEQ ID NO: 9 - DNA, 1794 bp, Pinus radiata
ctggcggttatatatttctatcacattctcaccatcaatggcattcaaaagtctcagttctctttgcagattacatgtatacgattcatatgaactgttgagttgttcatctgagagttgcagtctgcactaccttggcataaagcacgagatcacatcacaccaaatgaagcaaacggacagaacagtttgcgtgaccggagcagggggattcattgcctcttggcttgtcaagatgctcctcaagagaggctacactgtgagaggagcagttcgcaccaatccaaatgatgatggatcgaagtatgagcatcttagagcgctggaaggagcaaaagagaggcttgagcttgtgagagctgatattctcgattacaagagcttagtcgcagttatccgaggctgccatggtgtatttcacgtggctactgctatgagcaataaccccgaagaggtaatagagccagcggtgaaaggaacgaagaatgtgatggaggcttgcgcagaaatggcggtgaagcgcgtagtctttacgtcttctttcggtgttgtttacctggaccctcacagaaacccattcgccatagtcgatgaggattgctggagcaatttggactactgcatacagaccagtgtatttattactttctctggattaatacactgctctcaatatatttagacatatcaagttggaccgtatggatttgggctaactctattacttggttttgttcattaaatgcagaattggtattgctatgcaaaaacattggcagagaaattggcatgggagcttgccatgaaattgaatttagagctggtagtggtgattcctgggctagttttaggtccgaaattgcagtccaccatggaccatggcactgctcatattatgaaatatttgacaggtgggcaatgctttctataatagtttagccgattactgatttaatagtagaattgacggatctatgactatgattggatcgatggccagggtcagcgaagacatatgcgaacttaacacaggtatatgtggatgtgagggacgttgcaggggctcacattttagtgtatgaaacgccttcggccaaaggccacagatatgtgtgtggagaatgcaacatccaccgtggagacctggtcggcatgttggccaaactgtgcccactctcgcccctccctaccgagtacacaccacggcaatcttacataatatattttaatatatttctgttcaaattaaatatacatatctggaaacatgtttataacgaatcaaacaaaataaatagtgtaatcatgtgcaccatcatgcatgcaggtgttcagaccagataaatccaaggaagcagccattcctgttttccaatcagaagctaaaggatttaaatttctcgtttacacctatgatcaagactttagttgacaccgttgaaagcttacacaaagatgggttacttcaacgccatctctcagggtgggataacatggatgataacccctcgctgttttctaggatatgataaaataaagggaatgatactagtcaactcaataaagggaatgcctgcacttgggtgctcagtaggatgatttgaattattacttctttgtcacggtagtttttaatgtttcaacgcaacctgcatcgtgctattaagctcatggttaatggagataaattcaggaattgagatagtatttctcaagtttgattatgttaataccctgccataatgttgaagatttgcatgcccaatatctttttatttttgattaaaaaaaaaa

SEQ ID NO: 10 - DNA, 1353 bp, Pinus radiata
gtttgatgagctagttgcctgacttcatatcaacggttgagttgctcatctgagagttgcagcctgcactatcttggcaaaaagcaccagataacaccagataacaccaaatgaaagaaacgaacagaacagtttgcgtgacgggagcagggggattcattgcctcgtggcttgtcaagatgctcctcaaaagaggctacaccgtgagaggagtagttcgcaccaacccaaacgatgatgggtggaagtatgcacatcttagagcgttggaaggagcaaaagagaagcttgagcttgtgagagctgatattctcgactaccagagcttagtactagtcatccgcggctgccatggtgtatttcatgtggctaccgctatgagcaataagcgcgaagaggcaatagcgccagcggtgaaaggaacgaagaatgtgatggaggtttgcgcagaaatgggggtgaagcgcgtagtttttacgtcttctatcggtgctgtttacctggaccctcacagaaacccattggccatagtcgatgaggattgctggagcaatttggactactgcatacagaccagtaactggtattgctatgcaaaaaccttggcagagagatcggcatgggaggtagccaagaaattgaatttagagctggtagtgttgaatcctggggtggttttaggtccgaatttgaagtccaccatggaccagggcactgttcatattatgaaatacttgacagggtcagcgaagacgtatgacaacttaactcaggtatatgtggacgtgagggacgttgcagcggctcatattttagtgtatgaaacgccctcagccagcggccacagatatctgtgcgcagaatgcagcatacaccgaggagacctcgccgacatgttggccaaactgtgcccacactgtcccatccctaccgagtgttcagaccagataaatccaaggaagcagccatatgatttttccaaccagaagctaaaggatttaaatttctcatttacacctatgataaacagtgtagctgacaccgtcgaaagcttacacaaaaaggggttacttcaacgccatctttcagggtgggatgacatggacggcagccaccgtctattgtctaggatctgagaaacggaatgatacaagttaatcctgtaatccttaatacaagttaatcctatatatttctacgagctttagaacatataacgtacttagatgctcactaggatttgaattattacttatctgtcatagtagttaatgtttcaaggcggcctacattgtaatattcagctgaataatgaagatatcaattcggaattgggatcgtataaaaaaaaaa

SEQ ID NO: 11 - DNA, 1345 bp, Pinus radiata
gggagtcctcttgtcaggctccgctgcttcttgtgatcacacgatacctagtgatccatagataactaaaatgctgtgagcagtctgaattcttgctttctttccccatatacaagtccctcggagtaccagtatccgagccctgcagacttacaattgcattcatttgaaacccaaataacgcaaattgggtctgtgaattacctatattggtgtccatagatagtataaccatgactgcaggtaaacaaaccgaggaaggccagactgtctgtgttacaggagccggaggattcatcgcctcatggctggtgaagctgctgcttgaaaggggttataccgtgcgaggaacagttcgcaaccctgaggatcagaagaatgctcatctcaaacagctggaaggtgcagaagagaggctgacattggtaaaagcagatcttatggactacaacagccttttgaatgccatcaacggctgccaaggagtcttccatgttgcttctcctgtcacagatgatcccgaagaaatggtggagccagctgtgaatgggacaaaaaacgtcctggatgcttgtgcagtggctggagtgcgccgtgtggtgtttacttcctctattggggcagtttacatggacccaagtagggattatgatgctcttgtggatgagaactgttggagcaaccttgactattgcaaggagacaaagaactggtactgctatggaaaaacagtggccgagaaggctgcatgggaaagagcgaaggacaaggggttggacctggtagtggtaaatccatgtgtggtattgggtcctgtgctgcaatcctccattaatgccagcataattcatatactcaagtatttgactggatctgctaagacctatgccaactcagttcaggcctatgtccatgtcagagatgttgcagaggctcacatcctggtttatgaaagcccatcagcttcaggccgctatttatgtgctgagagtgttctccaccgtggtgatgtggttgacttgctggcatcgatgttccctcaatatccaattcctaccaaggtcaaggaagatgggaagccaagggtgaagccttggaaggtttccaaccaaaagctcaaggacctcggattagaatttacaccagcgaaacaatgcctgtatgagacagttatcagcttacaagaaaaagggcatatttccaagtgatcttattgatcgacattgaaatccatattttaatatataatggaaaattgtatatcaataaaaagtttgtgatattattgtttgacattggtatccatattaatatatgatggatgatcgtgtaccaaaaaaaaaaa

SEQ ID NO: 12 - DNA, 1284 bp, Pinus radiata
gcacatatctgtgaagttgctcatctcggagttgcaggctgcagcttttggcccaaagcatgatatcagatcaaacgacgcagagtaagcaaacggatcaaacagtttgcgttactggagcagcgggtttcattgcctcatggcttgtcaagatgctcctcatcagaggttacactgtcagagcagcagttcggaccaacccagctgatgataggtggaagtatgagcatctgagagagttggaaggagcaaaagagaggcttgagcttgtgaaagctgatattctccattaccatagcttactcacagtcatcagaggttgccacggtgtctttcacatggcttcagttctcaatgatgaccctgagcaagtgatagaaccagcggtggaagggacgaggaatgtgatggaggcctgcgcagaaactggggtgaagcgcgttgtttttacttcttccatcggcgcagtttacatgaatcctcatagagacccgctcgcgattgtccatgatgactgctggagcgatttggactactgcgtacaaaccaagaattggtattgctatgcaaaaaccttggcagagaaatctgcatgggatattgctaagggaaggaatttagagcttgcagtgataaatccaggcctggccttaggtcccttgttgcagcccgccatgaaccccagcactgcacatattatgaaatacttgacagggtcagcgaagacgtacgcgaacttaacacaggtatacgtggacgtgagggacgtggcagaggctcacattttagtttacgaaacaccctctgctactgggcaaagatatctgtgcgcagaatgcagtctccataggggagacctggtccaaatgctggccaacctgtgtcctcgttatcccctccctacgaagtgttcagatgagataaatccgagggcccagtcgttcaaattttcgaatcagaagctgaaggatttgggtctctcatttaggcctataaaccagtgtatgactgaaaccgtggccagcttacacgacaagggtttccttcaacacctccctccagcttgggctgacaggggtggcagccaatcaatattggcgaggatgtgacaggggtggcagccaatcaatactatctctgtgatagctactgtatctctactctcttttctgagaatgtctttaccacgatgtcattaccagtgtactatttctgtgatacctactctatgtaaattcattttttattaatgataatgctgtttttattattttaaaaaaaaaa

SEQ ID NO: 13 - DNA, 1366 bp, Pinus radiata
gttgtacagagcttaatccttttcaatattttctcagtatcttcccagccctgcttaatgttctttaaaagggtgagatctccgcttcatttcccacacctccagcgactcctcatctgtcatatttcaactgatagcttcgaacgagaagcccaactcaggcatttatagttcactgcttactccaaattgcagcctgaaataaaccatgagatcagatcaagctgtctgtgtgactggagcagggggattcattgcctcatgggtggtcaagaaactcctcagcaaaggctatactgtcagaggagcagttcggggcaatcctgaggatggcaagtatgagcatctgagagagctggatggggcgaaagagaggctgcagcttgtgaaagctgatattcttgattatcagagcttagtcacagttatccgaggatgccatggtgtctttcacatggcttgccttctcaacgatgaccctaatcaggtgatagagccagcggtggaaggaacgaggaatgttatggaggcgtgtgcagaaatgggggtgaagcgcgtagtatttacatcttctatcggtgcggtttacatgaatcctcacagagaccctcgcgccattgtcgacgatgaatgctggagcgatctggactactgcatgcataccaataactggtactgttatgcaaagacgttggcagagaaatctgcatgggagattgctgagagaaggaatttggatatggtagtcatcaatccatgtctggttttaggtccattgttgcaatcaaccatgaacgccagcactggtcatattatgaaatatttgacaggctcagcgaagacgtacgcgaacttaactcaggcatatgtggacgtgagggacgtggcaggtgctcatattttagtttatgaggcacgttcagccggtggccaaagatatctgtgcggtgattgtagcctccaccgaggagaactcgtggacatgttggcaaaactgtgcccgcgctgtccagtgcctaccaaatgttcagacgagataaatccaaggaaacagccatacaagttttccaatcggaaaatcagagatctgggcctctcattcatgccaatagacaagtctttggctgatacggtggcaagtttacaggagaggggttttcttcaccatctctgacgacctcacaaacaccgaggagactaaatacggccgtggacagtcattgtcagtccaagtgtcttcgcagatcgaatgtataccgagtgttctggtcgatttgatcaaatatatcaacttgtaaactttttgcgactctacgccttcgtggatcaaatatcttaataatatcatcaacttagatccatggtc

SEQ ID NO: 14 - DNA, 1176 bp, Pinus radiata
gcggtattttgccttcattttcttggacaggtcaagcaatcagtattgttatcgttgacttgagtgaagtggaagagcaacgagtacattttgccgaaaatggatgagaaggtggtatgcgtgacaggaggaagtggattcataggatcatggcttgttcgtcaattgctggagcgtggatacacagtgcatgcaactctccaaaatctgagtgacccaaaagagagagaccatctggaagccttggaaggtgctaaggacaggctcaaattatttcaactcgatgttctggactatgattccatggcagcagcgatcaatggttgccagggagttttccatctcgcatctccatgtacactggaagagttgaaggatcctcaggttgagctgctggatccggcagttaagggtacactgaacgctttggaagcatctcgcagagctcaagtgaagcgtgttgttctaacatcctccatctcttccttggttcccaatcccaactggcctcccaacactgtcattgatgagaattcatggactgacatagaatactgcgaacgtgacaagatttggtaccctgtgtcgaagactcttgcggagaaagcagcatgggaatataccaacacccacaaaatggacatgttgtccattcatccttcaacttgtttgggtcctcttctacaacccagattgaacgctagctctggtgttctcttgcagcttttacaaggtacacaagatactcaatcaaattattggttgggatgtgttcatgtggcagatgttgcaaaagcccaaattttgctatatgaaactccatcagcatctggccgctacctttgcaccaatggtataattcatttcagtgactttgcagaggtagtagccaagatatgtcctgaataccctgtccacaggttcaccgaggaaacacaacctgggttagtaagatgtaaggatgcagcaaagaagcttattggcttgggacttaatttcactccaatagaggaggccattcaacaatcagttgcaagtatgagagagaggggatttcttaaagaaattcctaaagcatataaggtttagaatttaatttatacagcctcgtgccggagtacttctagagcggccgcgggcccatcgattttccacccgggtggggtaccaggtaag

SEQ ID NO: 15 - DNA, 1217 bp, Pinus radiata
aaaatgcagagacaggtgagggacgaagctaataggataatggatggagttgtagcaagaaaatgcaaggtctgcgtgacgggggctggagggtacatcgcgtcatggctcgtcaaaaatcttttgatgacgggatatagcgtcaacgccacttttagagatccaggcaacgatagcaaaactcgccatattctgtgcctgccgggagcaaaagagaggctcagactcttcaaagccgacctccgccaagagggaagcttccatgctgccgttgagggttgtgagtacgtttttcatttggcaactccaatggattttgccattgaagcacagacacagacaaatgttatcgacgctgaggtgaatggtactcttgatattctgaggacttgcagtcaggcaaagtctgtgaggcgtgtaatttacacatcatccataactgcagcctccccacttaatgatgatggcgaattcagggactgcctcgatgaatcttgctggaccccaattgatatcatgagacgcgaaaagcctattttctggatgtattatgtagcaaaaacattagcagagcaagcagctcttcaatatgggtcagaggatcatggtattgaagtagtgacgatagctccagctatagttgcaggaccttttcttacacccacacttcccgccagcattgaacaagcattgccattcatcacaggaaatgctgaacattttgaatggttaagggagcttcatgatatcatgggctccattttattagtccacactgaggatgcctgtaatgctcacatattcttgatggagcatccctctgcgagaggtcgatatatatgttcttctccacctctcactctgcgagaaatggaggatttctgtgctaaacgttatccacaattctccctcccactcaaatttcacatcaaagacaatgttcttaatggtgtgccctttccttcaagaaaattgctggacatcgggttcacttaccagtatgaattagcagaaattttagatgatagcattgaatttgcaaggaagataggcgcactaccctaaacatgcaagtgccaaagatgtttggttggttgcagatgagataaataaaatggtgggatattttgtggtttgtattaaaaacatgtttcttaaattaatcttaactttgaatttataaattataaaaggattattttcttttaaaaaaaaaa

SEQ ID NO: 16 - DNA, 1903 bp, Pinus radiata
aaagaaagcaaatattaacagtacattaggacttttcattgatagatgaacacttcacattcaccagcgactggtcccgcaccttatcctgccagccaaaaataaaagattgcgagaagctggtgcgatgtgaaagatagccttggaatcttaggacgctacctgaggacgttgcctttttgctatataaatagggctgagcctactcaagatcttaagctgaagctcagagtgtgagctaagtgaccgaaatgaagatgggaacgatgattgtctttcttttcctttatataaatctctgcatggctgagcaatttgtatggcagccaggtcaagagatcgacactagcgggctgagtagagccagttttcccaagggttttgtgttcggaacggcgacttcggcttaccaggtggaaggagctgccaagtccgatggacgagggccgagcatttgggatacttttatcactcaaccagggattgtagctaacaatgccactgccgatattacggtggatgaataccatctctacaagagcgatgtagagttgatggtaaagatgaacatggatgcctaccgtttctcgatatcctggtccaggatttttccaaaaggagcaggtcggatcaattacaagggtgtccaatattacaataatctcattaactacctgcttaaaagaggtatcacgccctatgcaaatctttatcactatgatttacccgaagctcttgaaacagcctatggagggttgctgaattctagagttgttgaggactatgcaaaatttgcagagttctgcttcaaaacctttggtgacagggtgaaatactggatgacgttcaatgagccacgggttgttgctgctcttggttatgacaatggcatttttgctcctggaaggtgctctgctccatttgggaactgtacagcaggaaattcggctacagaaccctacattgttgcacacaatttgctgctttcacatgctactgctgtaaagatttatagagaaaagtatcagcccatgcaaaaaggaaaaattgggatacttttggactttgtatggtatgagcctcttacaaattccagtgaggaccagggagcggctcaaagatcaagggatttccatattggatggtttctccatcctattacctatgggaaatatcctgattctatggtggaaattgttgggacaaggctgcccaagtttacaaaggaacagtcccaaatggttaaaggttcaatagactatctaggcgttaaccaatacactgcttattacatgtatgatcctaaacaacctaaacaaaatgtaacagattaccagatggactggaatacaggctttgcatatgctcgcaatggagtgcctattggaccaagggcgaactccaattggctttacattgtgccttggggtctatacaaggccgtcacatacgtaaaagaacactatggaaatccaactatgattctctctgaaaatggaatggacgaccctggaaacgtgacacttccagcaggactgcatgataccatcagggttaactactataaaagctatttgcaaaatttgattaatgcagtgaatgacggggcaaatgtggtgggatactttgcatggtctttgctggataattttgagtggaagtccggatacacctcaaggtttggagtggtttatgtggattttactactctgaagcgatatccaaagatgtcagcttattggttctctaaactcctccaacgtcactagtcaccccaactctgctgcaagtggtagcactagttatgtgtaatcgctccggactgagaagtcctagtatgcaagtcccaccatccattttaaaatataaaataataacaaatgatttcagagtaaaaaaaaaa

SEQ ID NO: 17 - DNA, 1694 bp, Pinus radiata
gatcagattgcagatgccaaagatgagcacctccctgtttttcgttgccgtgactgctcttacattaacgatattgcaaagatcggaagcccaatgtgatccaaactccacagtggatttcaaaagaaagagttttcctcctggatttgtatttggcaccgcctcctcagcgttccagtacgagggagcagtaaaagaagatgggcgaggagccagcgtgtgggatacatactcccataaatttgggcgtatactggatttcagcaacgcagacactgcagacgaccaatataatcgttacaggaaggatatggagcttatggtggatttggggatggatgcctacagattttccatctcttggtcccgcatattccccaatggaagtagagatatcaaccaagcaggggtcgatcattacaataagttcatagatgcgctcctggaaaagggaatcaagccatatgtgactctgtatcattgggatcttccacaagcgctagaggatgcttataagggctggttgaactctaatattatagaggactatgcgaattttgcagaaacatgcttcgagaaatttggggacagagtaaagaactggatgacattcaatgagcctcacacagtctccgttcagggctacgatgcaggcctctttgctcctggacgatgctccgttctgttgcacctcttttgccgcgctgggaattccgctacggagccctatatcgttgctcataacatccttctttctcacgccaaaaccgtagacatttacaggaccaagtataaggcaaagcaaggcggaagaattggtatcgcattggatgtgatctggtacgagccaatgtcagattcccctgaagacattgctgctacacagagagcacaagatttccagttgggatggttcatgcatccgctgttcttcggagactatccggcgtcgatgcgagaaagagtcggcaaccgactgccgttattctcgtcggaagagtcgaatcagataaaaggttcgctggatttcgtgggcattaaccattataccacatattacgccaggaacaacaagacccacatcacctcggctcttctcaacgatacgctgtccgattccggcgttgttacccttcccttcaagaatggaagagctattggtgacaaagcgtcctccatatggctttacatagtgcctcaaggaatccggagtctcatgaattacataaaacgacgttacaacaaccctcccgtcattatcacggaaaacgggatggatgaccccaacaatattttgattcccctgaaaaaggcgttgaacgatcagaaacggataaaatatcacgcagactatctctccaatctttctgctgcaatcaaggaagatgggtgtaacgttggcggttattttgtgtggtctctgttggataattgggaatgggcagcggggtatacttcaagatttgggctctatttcgttgactacagacacaacctcaccagacatcccaaagcgtctgtccaatggttcaaatgttttctcactccataaatagatggcgtgtctgttattaaacgttttccttccttcatggcgtgaacattcaaaaatacccaatacatacgtttcgctatcacatttgtttaagcgataaatgcaacctcacgggcatatttgatttttaaaaaaaaaa

SEQ ID NO: 18 - DNA, 2253 bp, Pinus radiata
cgaacgcctagtatccatggcgctcactgtcgaagctcctgctgctctccatctgcaagaggaagaaagcgaaaatgtcaaagaaattagcagagataaatttccggagagttttgaattcggagttgcgacctccgcctatcaagttgaaggtgctgcaaaaggaggaggaagaggccctagtatttgggatacattttcatatacaccagggaaaattattgatggaagaaatggtgatgttgcagtggatcaataccatcggtacaaggaggatgtggatttaatagcaaaaatgggattcaatgtgtatcgtttctcaatatcttggtctcgaatctttccagatggatttggagctgaagtgaataaggaaggaatagcatactacaacaacctcattgatactctcctgcagaaaggtgtacgaccatctgtaacgttgtaccattgggatcttcctcaaaaacttcatgaatcaatgggtggatggcttaatagagaaatcgtaaactacttcgcactgtatgcagaaacatgctttagcgcattcggtgaccgagtaaaacagtggataacattgaatgagcctttacaaactgcagtcaatggttatgccactggaattttcgctcctggtagatgttctgatagatcacagagtcctgttggagattcatctacagaaccatatttggttgcacataatcaacttcttgctcatgcagctgctgttgatatctatagaaagaaatttcaggataaacaagggggtgtgataggtataacagtagatggtgaatgggcagagcccttcacagacgccgaaggggataaagaagcagcacaaagacgacgtgaatttcagtttggctggttccttgatcctatatattttggtgactatcctgcaatcatgcgaaagaagcttggtgatcgacttcctcaattttcacctgatgaggttgctgtattgcgtgggtcatcggattttcttggactcaatcactatacaacacgttatgtgataccatctttccgggactccaaaaaagatgaattttatgttgatcaagatatacatagcattgctgaatgggagggaaacaccattggagaaagagctgcatcagagtggctttatattgttccatggggtttccggaaggtattgaagtggttaacggagagatacaacagacctcctatctatgtcacagaaaatggaatggatgatgaggactctgaaatcacattacttgaccaagctcttaatgatacaaaaagagtaaattatttcaagggctacttgaaagctttggccgaggccatcagggaaggtgcggatgttcgtggctattttgcttggtctcttatagacaattttgagtggggtcaaggctacacaaagcgctttggtctagtatttgtggattacaaggatgaccttaagcgatatccaaagtcatcggctcattggttcaccagctttcttcatggaactgacaagcaagcttgtcttgtgaatggtgagaacggacgttagaaggcttctgcgtcgctcttcattttacaggacaaatttacatgatatattgattggatattgtgtttcaacatgtgggcttagatcaattttagatagaggacataattgtagatgctgtacatgagacaactacctatggctagggtatggcagttaacaatacactgattcagttggacatgttcttcaattctattcctgttagtataggaaaagattgtggcagagaattgggtgctcattttcataactcataatggtcagaaattccatggttttgcaacttttttaaagcgcaaccatccctttgagaggcaagccactcagcttgctaagctctgtttgaaactataaaatgacgtacattttctcacagttgataatattggcgatatattagtgatattcgaaaacatcgcgatattttcggcaaaacgatatattgcgagaaaatattggcaaaatatcgcgatattttgaaaatatagggaaaatatcggctatgtttaaaaatttgaaaaaattatttcttatgcttgctgatatttgctaatattttcaccaatattgacgataagatattttctaaaccctcgccgatattttgccgacaccgatattttaaacactgcattataagataagttatattcttatttttattccaattcaaagataaaatagtttggtttttaaaaaaaaaa

SEQ ID NO: 19 - DNA, 1946 bp, Pinus radiata
gcgctttatagggtacaaaatccgtagcaatatcattgatttgcctggtcgctttatattgagtccacaacatactctcaaagtacaagccacacgaactgtgcacggctgcttgggtgccctcatcctcaatttcattatactgattctcatctgaactgaagcttcagcctacagtcttcaaccaatgagtattaatatagcagacatgagaatagtaggatcaattatagttttagaactgctgatactgctgagtctgtccgctgtttctgcctatacacaacacctatctcgaaattacttccctcctgacttcatttttggtgttgcctcttctgcttatcagtatgaaggtgctgcagcagaagatggtcggaagccaagcatttttgacactttcactcataggaaagggactacaatggatggaggtaatggagatgtagctgttgatcaataccatcgttacaaggacgacattgatctaatgtctgcaatgggagtagatgcctatagattttcaatctcttggcccaggcttattcctgatggtaaaggaccaatcaacccaaagggcattgagtactataataacctcatcaacgagcttttagccaatggcattcaaccacatgttacattataccactttgatctgccccaagctctggaagattcctatggaggttttataaatccacaaatagtggaggattttgtactgtatgcagatgtgtgtttcagagaatttggtgatcgagtgaagtattggtccactttcaacgagcccaatatatttgcaattataggttatgatggtggatttttcccacctcaaagatgctcccagccattcggaaattgtactgctgggaactcaactgttgaaccttatattgttggccatcatgtcttgctagcacattcagctgctgtggagctgtacaggaaaaaatatcaggcaaaggaaaagggatggattggattagtaattttagcaaattggatgataccgcttaccaataaatcgacagatgtagctgcaactcaaagagcaaatgactttatgctgggttggttcttagatccgcttgttttgggaaactatccagtgggtataaggaatgtagtaggttctcgattaccttcatttacagaggaacaggctcagaagatacgaggctcgttggacttcattggtgtcaatcactattttaccatgtattgtttcgatgttccaagaaaaaatgctcctatgtcaagagactatgctcaagatatgtctattggatacgcagtggagcgagatggaatccccatcagcaatacgacaacattaaatggtaatccagttttaccacaaagtatgcaggcagtgcttgaatatattgaggatcgttctcataatactcccattcttgtgtatgaaaatggatttgcagagcctaataattcttctattcccctctccgaggctttaaatgaccaatacaggattgatctccaccgggatgttctttcgtatgtgcttgcagcaataaggaatgggtcagatatccgtggatactttatatggactctactggatgactttgaagttttgactagttacacttggcgttttggtcttcattatgtggacttcaatgacaacttgaagcggtatgccaagctatctgctcattggtacaagacttttctgcagaggcgggacagcaaaggatcacaaattctactcaacaccaacagtttcatgaacctctcatagaattatgatttattttatgaaaaaacaatggcattatgttttgaacatgattttgttaaagaccaaaacctgatgtttatgttctatgttcccatacaaaatgcttttataacacataatatataatatgtataccttgcaggaatgcattttttaaattaaaccaaaaaaaaaa

SEQ ID NO: 20 - DNA, 1934 bp, Pinus radiata
gggatatcgttgaggtcatccaattattaatcggcacggaatttgaaagcttgacgcagcaattttgcgtgtattgtcatcccgttgaaaagtctttgaagagagcgccgacacgctctttaaaactgcgcgctgatttgatttcggaatccattcgattgcaatactattagattgcagacgcgaaaaatgagcccttctcttttatacatagctgcgaacatttttttgttaactgcactgcaaagatcggaggcccaatgtggtccaacctcgacagtagatttcaacagaagggattttcctcctggatttgtatttggcaccgcctcctcagctttccagtacgagggtgcagttaaagaagatggaagaggacccagtgtgtgggatacatattctcataaatttgggcatatactggatttcagcaacgcagacgttgcagaagaccaatatcatcgttacagggaggatatccagcttatggtagatatggggatggatgcctacagattttccatctcttggtcccgcatattccccaatggaaatggagatatcaaccaagcaggggtcgatcattacaataaattcatagatgcgctgctgcaaaacggaatcgagccatacgtgactctgtatcactgggatcttccacaagcgctagaagatgcctataagggctggctaagccctaaaattatagatgactatgcgaagtttgcagaaacatgcttcgagaaatttggagacagagtgaagaactggataacattcaatgagcctcacacagtctccgttcagggctacgatgcaggcctctttgctcctgggcgatgctccgttctgttccacctcttttgccgcgctgggaattccgctacagagccctatatcgttgctcataacattcttctttctcacgccaaagccgtggacatttacaggacaaaatttaaggcaaagcaaggcggaagagtcggtatggctttggatgtgatctggtacgagccaatgtccgagtctcctgaagatattgcagctacacagagagcgcaagatttccagttgggatggttcatggatccactgtttttcggagactatccggcgtccatgagagagagagttggcaatcgactgccgttattctcatcagaagagtcgagtcagataaaaggttcggtggatttcgtgggcgtcaaccattataccacatattatgtcaagcacaacgaaaccgacatcatctcagttctgctcaacgatactctcgccgactccggcagtttggccctccccttcaaggatggaaaagccataggtgacaaagcatcctccatatggctttatatagtgcctcaaggaatccggagtctcatgaattacataaaacaacgttacaacaaccctcctgtcattatcacggagaacgggatggatgactccaacaatattttcattcccctgaaaaaggcattgaaggatcagaaacggataaaatatctcacagattatctctccaaccttgctgctgcgatcaaggaagatgggtgtaacgttggcggttattttgtgtggtctctgttggataattgggaatgggcagcggggtacacttccagatttgggctctattttgttgactacaaacacaacctcaccagatatcccaaagattctgtccaatggttcaaatgttttctcgctccatagatacacccaccccttcattattaaacatttccttcttttctttaactgccggattgacattagcatccccaaatgcccaatacatccgtttcacaatttatttattatatttgtttcagcaataaatgcaatctcaacggcatatttgccgtacaaggttcagctggtgtagccattgaataataaattatttatttggttgaacaaaaaaaaaa

SEQ ID NO: 21 - DNA, 2051 bp, Pinus radiata
gcaggatttggacctgaaaataccaatttcaaagcaattccagagggataacgtgggatccttaccattaccaacaacccacaattccgccctgccgacctcaggcatcttttgattatatttaaccattaattcatctgggcagttgtgattctgtataattcgatcgctccattttagcagacatggaggtgtctgtattgatgtgggtactgctcttctattccttattaggttttcaagtgacgacagctaggctggacaggaacaacttcccctcagatttcatgttcggcacagcttcttcagcgtatcagtatgagggagcagtccgagaagatggcaagggtcctagcacatgggacgccttaacacatatgcctggtagaataaaagatagcagcaatggagacgtggcagtcgaccaatatcacagatatatggaagatatcgagcttatggcttcacttggactagatgcctatagattctccatatcctggtctcgaatccttccagaaggaagaggtgaaattaacatggctgggattgaatattacaataatctgattgacgctcttctgcaaaatgggatccagccgttcgtgacattgttccatttcgatcttcccaaagcacttgaagactcctatgggggatggctgagtcctcaaataattaacgacttcgaagcctatgcagagatttgcttccgggcattcggtgaccgtgtcaaatattgggcgacagtgaacgagccaaatctgtttgtgccgttgggatacaccgtcggaatatttccaccgacgaggtgtgctgcccctcacgccaatcctttgtgcataacagggaattgctcgtcagcagagccatatctagctgcacatcacgttttgctcgcccacgcatctgcagtggagaaatatagggagaaatatcagaaaattcaaggaggatctatagggttagttataagcgcgccatggtacgaacccttggaaaattctccagaagagagatcagctgttgacagaattttatccttcaatctccgatggtttttggatccagttgtttttggagattatccacaagaaatgcgtgaaagattaggatcgcgcttaccctccatatcctcggaactatctgcgaaacttcggggatcgttcgactatatgggtattaatcactatacaaccttatatgcaacaagcactcctcccctttcccccgaccacacgcaatatctatatccagactctagggtttatctgactggagagcgccacggagtctccatcggagaacggacagggatggacggtttgtttgtggtacctcgtggaattcagaaaatcgtggagtatgtaaaagaattctatgacaacccgactattattatcacagagaacggttatccagagtctgaggaatcctcgtcgactctgcaagaaaatctaaacgatgtgaggagaataaggtttcatggagattgtttgagttatctcactgcagcaatcaaaaatggctcagatgttcgagggtactttgtgtggtctcttctggataattttgagtgggcatttgggtataccattcgatttggtctttatcacgtggatttcatttctgatcaaaagagatatcccaagctctcggctcaatggttcagacaatttcttcagcacgacgatcagggaagtattagaagcagcagcagcatttagactgcgttgtctatttgctaatcaaagcgcacacattcctgcaactctacccaaaatcctgcaagcaaatatgttgtgttcggatctatccaccgtgagacacattacaaagaaatcatcaatctattccaaaatgcagaaaaccccattcagatgttccagggaattgcagagtaagaacattgaaacaaaaacaaaaaaattgcacgatatgcgacacgtgtctatctaaatcgttgtactatcctatatctttttaaaaactactatgcatatattaaagagctcataattttatatctattgagatgaccaaaaaaaaaa

SEQ ID NO: 22 - DNA, 1379 bp, Pinus radiata
cttccttgccatctgcaagcaatacagtacaagagccagacgttcgaatcctgtgaagtggttctgaagagatgggaagcttggaaactgaaaaaactgttacaggatatgcagctcgggactccagtggccacttgtccccttacacttacaatctcagaaagaaaggacctgaggatgtaattgtaaaggtcatttactgcggaatctgccactctgatttagttcaaatgcgtaatgaaatgggcatgtctcattacccaatggtccctgggcatgaagtggtggggattgtaacagagattggtagcgaggtgaagaaattcaaagtgggagagcatgtaggggttggttgcattgttgggtcctgtcgcagttgcggtaactgcaatcagagcatggaacaatactgcagcaagaggatttggacctacaatgatgtgaaccatgacggcacccctactcagggaggatttgcaagcagtatggtggttgatcagatgtttgtggttcgaatcccggagaatcttcctctggaacaagcggcccctctgttatgtgcaggggttacagttttcagcccaatgaagcatttcgccatgacagagcccgggaagaaatgtgggattttgggtttaggaggcgtggggcacatgggtgtcaagattgccaaagcctttggactccacgtgacggttatcagttcgtctgataaaaagaaagaagaagccatggaagtcctcggcgccgatgcttatcttgttagcaaggatactgaaaagatgatggaagcagcagagagcctagattacataatggacaccattccagttgctcatcctctggaaccatatcttgcccttctgaagacaaatggaaagctagtgatgctgggcgttgttccagagccgttgcacttcgtgactcctctcttaatacttgggagaaggagcatagctggaagtttcattggcagcatggaggaaacacaggaaactctagatttctgtgcagagaagaaggtatcatcgatgattgaggttgtgggcctggactacatcaacacggccatggaaaggttggagaagaacgatgtccgttacagatttgtggtggatgttgctggaagcaagttggataattagtctgcaatcaatcaatcagatcaatgcctgcatgcaagatgaatagatctggactagtagcttaacatgaaagggaaattaaatttttatttaggaactcgatactggtttttgttactttagtttagcttttgtgaggttgaaacaattcagatgtttttttaacttgtatatgtaaagatcaatttctcgtgacagtaaataataatccaatgtcttctgccaaaaaaaaaa

SEQ ID NO: 23 - DNA, 1634 bp, Pinus radiata
ctagaatgcacatcccacgcaccaagggactacaggagtcaacccagaaccaacaattatgccgataccaaatttaacatggcaatgtgcagaagtgcattgattctaccggtcgattttcgacttattccctctcatttcctccgacggcataccattcgaacctgctgtcttcattactactcattcatccagcaaagccctccttttattatccacgattcgatttctgctgctttacaaacacctccccgcctgaaagtttcgaggcgctgcggaaacccaattccactggcaatggcaacgaaagcagattgcgaagaatcggggagaacaatgcgtgcaatggtgctggaatctcccaaaacactgttgaagagtgtgatgttgaatatcccagagcctgcggagggacatgttcgagtacgcgtatcagcttgtgcagtttgtcgcactgatctacatgtggtagatggggatcttgataagcccaagttgccaattattccaggtcatgaaatagttggggttgttgacaaggttgggaaaggtgtggattcaaatctctttagcattggaaaaagagtgggcattccttggcttggtcgaacttgtggcaaatgcacatattgcttagagggagcagaaaatctctgtgatgatcctgcatttacagggtatcaaattgatggaggctatgccgaatatgctgttgcacatgcatcatactgtttccctttacctgaaatctattctgacattgaggttgctccactattatgtgctggcctgattggttatcgttccttgagaaaaacgggcttcaaaccaggtcttgacaagaaaaagagaattggcatttatggttttggtgcagcagcacacattattgcacaggttgcaatccatgaagggcatcaaatttatgcattcacaagagcaggggataaggaagcacaagcttttgccctaagattaggggccatatgggcaggagattctatgtccttgccaccacatgaactcgatgcagctattttgtttgcaccagtaggacttcttgtaccagctgctttaaaggctgttagaaaaggaggcattgttgtcgctggtggaattcatatgtctcagattcctgcattcccatactctattttatggggtgaaaggcaggttgtttcagttgcgaatttgaccagacaggatgcacttgagtttcttgagcttgcacccaaggcttgtgtcaagactgaaactgttgttttccctttggaaaaagcaaatgaagcacttgcatctctcagagagggtcgattggagggtgccgctgtgctagttccatgatttggtttcaacttttggttgtggccttgtgaagcagaagtttgcttaggcaataaagtgctttatcctaatgatctagtatgaagggtttgttgagctggctgttttacagtctaggagttgttcaaagtatcatttcaatctctgggcctgcagttaatgtggatgccatctatcacttaagtttagattgtaattctatcagcctccattggtcagaagtctagaattatggaatgtaccatatgtaacagtttttggaacattgaaatgaagatgcttaaaaggcg

SEQ ID NO: 24 - DNA, 1583 bp, Pinus radiata
gtctggtggacgttaaaatttaatttaatgtcatttcatttataactttaacagggtattggatcgaccctgtcagatttgcaaacatcgagctgagcggagcttttcggatagtgcataaagtgaagggtgcaacagggatcctcaaactccgggagtaggtacaccatgaatactaaagaagacagcaatgtgaactgttcaggatgggcagctcgagatccatcaggtgttttgtcaccttaccaatttaaccgaagagtcccaggccttgatgatatctcattaaagataactcattgtggagtttgttacgctgatgttgcatggacccggaataaagttggtgattcaaagtatccattggtgccagggcatgaaattgttggaattgtgaaagaagttggcatcaatgtaatccgttttaaggttggcgatcatgttggagtgggtacatatgtcaactcctgtcagcaatgtgaatattgtaatgaaagaatggaagtcaattgtgcagaagggtctatttacacctttaatggtatcgatgtagatggcacagtgacgaaaggaggatattctagtcacattgttgttcaccaaaggtactgctttaagataccagacaatctaccactggcttcagctgcacctttgctctgtgcaggaattactgtttacagccctatgattcgtcatcacatgaatcatgcaggcaagtctcttggagtaattgggctaggaggtcttggtcatatggcagtaaaatttggaaaggcttttggactgaatgtaacagttttgagcacatctgcatcaaagaaggatgaagcattgagcattcttggagcagataaatttttattgtcatctgataaacagcagatagaggcttcttcaaagacccttgatttcatcattgacactgcttcaggggaccacccaattgatctttatatgccacttttaaagacttcaggagtgtttgtaattgtaggtttccctagtgaaatcaagatccatcctgacaatcttattattggcatgaaatcgattgcagggagtataacaggtggcaccaaagacactcaagaaatgcttgatttttgcgcaaaggaaagagtatatccaaacattgaagtcattccaatccagtatattaatgaggccttagaacgaatgattaacaaagatgtgaaatatcgctttgtaattgacattgagaattctctagtctcaaattgagctcccagaaccaatgtgcaggatgtgacactgctgattgaaaatctcaatgggtttttggcattatgttatatggtttgttatatcataatggacatatgatatggtcattatttatgattagccataattatatagacgactgaggcatctgtactatatagatagcctctcattatgtatattgtatcatcatacttattgaatacatttatggtttactgccttaacttcttcatggatttatgttactgcccttgggcattctattctcgtgaacacagagataagtctcgtgaataggcaatcgatacaatctttactattcaaaaaaaaaa

SEQ ID NO: 25 - DNA, 1351 bp, Pinus radiata
acgaacacatttgcagaatcttgaaggaacaaagatggcaagcgcactttctcctcaaaccataacttgcaaagctgctgttgcttggggacccggggaggcgatgagcatagaagaagtgcaggtggctccccctcagcttaaggaggttcgcatcaaagtggtcgccacatcaatttgccgcagcgatataacattatgggagtcccgggggcacactcctatctttccacgcatctttggccatgaggcaacagggatcgttgagagtgttggagaaggtgtaactgatctccgtgagggtgatcacgtccttactgttttccaaggggaatgcaagaactgtagacattgcaaatctgataaaagtaatgcatgtgaaactttaggaattgaaagaaatggtcttatgcatggtgatcagaagagccgtttttcaataaatgggaagcccatctatcactttgtggcagtttcaagcttcagtgaatatactgttgtacactccgagtgtgttgttaaattgagcccagatgttcccttgggaaaaattagtgtgcttggctgcggtgttgcaacaggttttggagctgcttggaaaatcgctaatgttggcaaaggatcaacagtagtcatttttggccttggagcagtaggcttagctgtagcacaaggtgcaaaattaaggggggcatctcggataattggtgttgatataaaccctgacaaatttgaaagggggaaagcatttggtgtcactgaatttatcaatcccagtgattacaagcaaccaacccaagaggttgtgaaggagataacaacaggtggagcagattattgttttgaatgtgttggtgatgttgaattaatgcggactgccttggagtcctgctgcgatggctggggcatggcagttctaattggagttcctagtggcaaaatggaactttcagcacattatggaccacttctcggtggacgcactttgaaaggaacactgcttggtggatggaaaactaggtctgagttgccattattagttgaaatgtacatgaaaaaggaaattcaaattgatgaatacgtttcacacgaattgccatttgctgacatcaacaaggcttaccagttgatgaaagaaggaaagtgcttgagatgtgttctacatgtaggaaattaattttgatatttcacctaatttcttattttcgtttatatccattttgagtgccaaaaaacatttactagtacctatggcatattgttgtaatgacacttgctagtgccaaactataataaaaattaacttcacaaaagtgcactgtagcacttgaaaagtttaacaaaaaaaaaa

SEQ ID NO: 26 - DNA, 1307 bp, Pinus radiata
accaaccgcatcacctccatcacaaaccaattacagaatcccctcaatcccgcagacgatttacacaaagccgccaacatgagcgaatcctacaagttccagggatggatgggtgtggataaggatgccaccaagggcaagatggtgtggcaagaattcgagcccaaggcctgggaggagagagatgtcgacgtcaagatcacccattgtggtatctgcggctccgatcttcatactctacgtagcggatggggtgctactgattacccgtgctgtgtaggccatgaggttgtgggtaccgtcgccaaggttggatctgaggtcaagggcatcaaagtcggcgaccgtgtcggtgtaggcgctcaaaccgacagctgtggagagtgtgaggactgcaaggacggacgaactcagcactgcgctaagagtgttggcacttatgccgccaagcactacaatggtggcaagagttatggaggatacgcagactactggcgaggacctgccacttgcatggtcaagatccccgattccattccttccgccgaagccgctcccatgctttgcggaggtgtcaccgtctggtccccactgaagaacaacggtgctggccctggaaagaaggtcggtgtggtgggtgttggtggtctcggtcatttcgccgttctgttcgccaaggctttgggttgtgacgaggttgttgccatccaacgtaacaccaagaagaaggacgacatcatgaagatgggcgctaccaagttaattgccacagacgaggaggaggactggaacaagaagcacggccgatctctcgacctgatcgtctcgaccgtctctagccccaaggcgcccttcgccaagtacctccagctcctcaagccgcgaggaaacttcattcaggtcggagctcccgaggacgtcttcccgccccttgcagccttcagcttgatcggcaacgagatcaagttcggtggtagcatcatcggatcaccatcggacatcaaggagatgctcgactttgtggagaagaagggcatcaagccttggatccaggagaggccgatgaaggatgccaacaagacggttgttgacatggacaatggtgaggccaggtacagatatgtcctggtcaacgagaagcacatctagagtgctggtcactggtcagcgaggacaatagctcctagaaggattttgagcatcgcccgctgccgtggacggggatctgtcttgggttgaaggatcagctagaatctagactcgcaacggcacacccaaatgcatggttttcgcattgaaaaaaaaaa

SEQ ID NO: 27 - DNA, 1913 bp, Pinus radiata
ggagaatagctgtgtatctctgcgctggttgcaggatccaagttcctctcagagccctccatggaagcgcagtcagtttcagttgttgagcagcgcccccatgccctactattttcatttccgttacagggccacatcaagcctttcatgaacttggccaagattttgtccagccggggcttctatgtcacttttgccagtaccgaatttgttgtaaagcgcctcgcagaatgtggtgaaagtatcgcccatcgtgattcgacggtgtgcagcgagaacgatgatgtatgtaacataaaattcgaaacagtgcccgacggactgcctccccaccacgatcgcagtactcagaatcttgcggagctcttccaatccatggaagagaacgctcatattcacttccacaagttgatggagaagctccagaatcttcgggaagtccctcccgtgacgtttatagtgacggatgggcttttatcaaagacgcaggagattgcaaacgaatatggcgttcctagggtcgccttctggacgactagtgcctgcgggttcatggcgtatttctccattcctcttctaatcaagaagggatatcttcctctcaaagatgagtgctgcctcagcagtgagtatctggatgaagtgagaataacttgcatcccgggaatgccaccgttgcggttgaaggagctgcccagtttctgcttagttacggatccatcggattttttctttcaaaatgcaataaatcaagtacaaggcacgttaacagctgatggattaatactcaacacattcgatgagctcgaaggcccagtcttggaggcactctcacttcacttccctgtctatgccattggtcctctgctgctctctcagtcatttcattgtaaggataagggtggatcctcagatgaattgagtttgtggaaagaagaaagtgggtgtctcacatggttggatactcggaagccatgctctgtcttgtacgtttgcttgggaagcctggcagtaatgtctaatgaacaactcctggaatttgcttggggattggcttccagcaaccaatccttcttgtgggttgtgaggtcagatatcgtgcatggtgaatctgccatattacccaaagagttcattgaggaaaccaaggatagaggtatgctggtgggttgggcgcctcagataaaggtactgtcgcacccatctgtgggaggatttctaactcacagcggttggaactctacattggaaagcattagtgcgggtgtgccaatgatgtgctggcccttctttgccgagcaagaaacaaatgctaaatttgtgtgtgaagagtggggaataggaatgcaggtgaagaaaatggtgaagagagaagagttggcgatactggtgaggaatttgatcaaaggtgaagaaggagatgaaatgaggaaaagaattggaaaactgaaggaaactgccaagcgagcagttagtgaaggaggctcttctaagaacaacttagacaagttactccaccatatattccttaagggaatgcatcaaatgatagtccagaatgttgaagcaaacaattagttagaagagaacgtgtaggacgaacgaaaacatcccagtaccccaagcgttcatatttctgcatttcgcattaaatttactttgcattgttccgcacatatgtattttcaggttgtcaggtttccccagagttgaacctcatttccaattagattgtttcacgtctttacggcgcaggggttgtgagcccataattattttttcagaactatggaagtcgtaaaagatatggaatgatgtttgtaagagtagaattggttggttggttgttggagtttttggagaggttttatcaataatttttttgttggaatttgtaaaatgtaaaaaaaaaa

SEQ ID NO: 28 - DNA, 1807 bp, Pinus radiata
caaaaacctgcagtccggactattttgttgcgtcgtttagtttagacatttacgaaaaaatcgcccgaacatggcagcaggtagacgccaagtatgtagtcaacttaacaatttgatgattaagtttggtgacatccgcctgtccctttgtattcaaatacttctttgaaaccccaactggtaattcaaatcttgaaactggactggactgtaatggcagcaaacgcagagaggaggcctcacgttctggtctttccattcccagcacagggccatatgattcctctgctcgacctcacccataccctcgcttgtggtggcctctccctaacagtcctcacaactcctcagaaccaacccctgttggatcctcttttgcacaaagcctctgtagagggtctttctattcaaccccttgtcattccactccctcccactaaaggactccctcctggatatgaaaacctggctcagattcctttacatctggtcttactcttgatggcttcgttcaaggagcttgctcatccaatagaagactggttccaacagcagaaggactcagattatggattcggccctcctgtttgcatgatcagtgatttcttcctcggatggacttacgataccgctaccaagctcgggatacccagaatagtattccatccctgtggtgcatttgatgctattctccactattctctgtggaaatacatgcctggaatactggagtctgatgatgatgaagtccattttctggaagcccctcatcctgttagttttgctaagcaccaaatctcttcccttggactactgtacaagaaatccgaccctgtatctgaattcatcagatatagcatgaatttgaatgtgaaaagctggggtaatatcatcaacacattctatgatctagaagctgtttatatggaccagctgcacagagtttctggcagccctgtttggtctgtgggtcccctgtttcctcctgctatgttcgatccgaagctgagaagaacgatgattgaaagaggcaaaccctcttcaatcaatgattcgctattgcagcaatggctggactctaggggagaaaagtctgttatatatatttgctttggtagccaggcctgcctttcaaataaacaaatcgaggagatggcagcagggctggaggcaaccgaagagtctttcatatgggtcatgagagatctgcctagtggtctgcctgctgatgaatatggtgcgcttccccaaggttttgaagagagaatggagggaagaggtctgataattagaggttgggcacctcagctcttgatcctttcacacccttctgttgggggttttcttacccactgtgggtggaactctaccctggagagcatcacaatgggagtgccattgataacatggcccctggccgcagatcaatactataatgctaggttattggttgaatctcttaagattggagtaaggttttgtgaaggtgccaccacggtgcccaacagagatgacctgagaattgcaattaagcggctgctgggaagagaaggagaagaaatgaaaagagcagaggagctgagcaaggcggcgagaacagcagtgcaagaagggggaacctcctacaggaacatcgaagcccttgtgagtgagatcaagaagctgatcctgcagcctagttaatctctggataccaaggtagaaaactcaatttcaagctatgatgtcttttgctgatgtacttttcatggagtcaaaagaatactagtggctgcctggtatttgcagtttgatgttaaaaaaaaaa

SEQ ID NO: 29 - DNA, 1657 bp, Pinus radiata
gggtgagtgaaattagcatagtgagaggtgtctggagcttcagaatttggacactttttgtagcaatttttagagtgtaaaggaatgggatcttcactggtgttcgactacagccaacttcgcgtcctggtggtgccctacccggcgcagggtcatatgaatccaatgctgcagtttgccaagaggcttgcctcgaaaaatctggaggtcacatttgtgataaccgaggcaagccgtaagagcatgttagaggcacaaggcgcagtatggggagcctcagagaaacgtgaggaaattcagtttgagacgatctcagacggacttgcagcggatgtcgaccggaacaacgtagagatagtgtcagatatgttgtcgaagataggagaagtgacgttaggaaatctggtagagaggctcaatgctcaagggaatcagatttcttgcatcgtttatgactcttttcttgcttgggttcccaaggtttcaaaaaaatttagcattccttcggctttcttctggacacagtcgtgtgctgcatatttggtttattaccattttttcataaaattggcggccgaatggcacgaaatgctgaagaccactgaggtgatagaaatagagggacttccaccgctgagtcactctgatctgccatcctttctgctacctgccaatccctttcggtctatcttgcgattaggcgtgcaacaatttcagtttctcccagaggtgacatgggtactggggaattcgtttcacgaaatggaatcagaagaaaacaactcaataaaatcagtacgtccgtttcgcaccgtcggtcctgccataccctctgctttcttggagggtcggaatcctggggaaacagactcgggtgcaaatttgtggaaaaccataaactgcacggactggctgaataggaaggagcccgcaagagttgtgtacgtttcttttggaagccttgcggttctttcaaaagaacaaactcatgaaatagctcttgggttgaaggccagtggatatcccttcatatgggtaattcgaccatccagttccaaagaggagattcacaatgacgaaaatttgccggagggttttctggaagaaacctccgatcagggactcatcgttccatggtgtccacagctggaagttctttctcatgtgtctgtcggtgcatttatgacgcactgtggatggaactcgactctggaaggactcagctctggagttcccatgttggcggtgcctcaatggagcgatcagatgcttaatgctctatacattgaagagaaatggaagacgggattgagattgagtaaacgatcagcagacggactggtagagaaagcggaagtggagaaatgtattaggatggtcatggaaactgagagaggcgttgagatgaagaagaacgctctacggtggaagacattagcgagggaggcaatggcggaaggcgggtcttcagacaaaaatattgaagaatttatcgaggagattgctaccgccaaggcatcctctatgagtggttagcatggtcctaattgatgagtgtatcttcaatgcggtggaataaaactgatgccatcatagtgccctaatatgtttttttaatttcccaacgttaaaagaagttttatccccaaaaaaaaaa

SEQ ID NO: 30 - DNA, 1926 bp, Pinus radiata
atgatcgctcgagagaaatttcgaaccagatcacagttctgacgtgagacgcctcgtttcataattaattaggagtcaagagcctgcgacagactgaattctcgaatatttgtagactttctgtagtgattttttgctgatagtcgttggagtttatgataatggcgtcattaatggggttcgattacagcaaacttcacgttctggtggtttgctatccagcgcagggtcacataaatccaatgctgcagtttgccaaactgctcgcctcgaaaaatgtcggggtcacctttgtgacaaccgaggcatgccgtaagagcattatagaggcgcaagacgcagtattgggaggctcaaagaagcgtgaggaagttcggtttgagacaatctcagacggactgacttcggattccgagcggagagacgtagaggtagtgctgaacatgttattcgagataggaggagaggcattggggaatctgatcgagaggctcaactctgagggcaacaagatttcttgcatcgttctagattcctttcttacttggattccgggcgttgcaaagaaatttaatattccttcggctttcttctggacgcagtcctgtgcagtgttttcgatttatcaccattttattgtcggagatatggcagcggcgtgggatgaaacatgggagactgttgatgcaatagaaataccgggacttccaccgctgagagtctctgatatgccatcctttctgctaccttcaaatccccacccgactctgtcgcgattcgtagtggaacaattccagtctcttccagaatcgacgtggatattgggaaattcgtttcaggaactggaatcggaagaaataaactcaatgaaattgatagctccaattcgcaccgtcggtcctctcataccctcggccttcctgggcagccgaaatcccggagacacagacgtcggtgcaaatttgtggagaagcgcaaactgcacggattggctggacaggaaacagcccgcaagcgttgtatacgtttccttcgggagccttgcggttctttcaaaagaacagacgtgtgaaatagctcttgggttgaaggcgagtggtcaccacttcatatgggttattcgtccctctgcttccgatgggggcatgacaagttataaaaacttgccggagggtttcctcgaagaaatctcagagcagggactcgttgttccatggtgtcaacagctgcaagttctttctcatgaatccgtgggtgcatttatgacccactgtggatggaactcgacgctggaaagccttagtttgggggtccccatgctggcggttcctcagtggagtgatcagatcactaattccacatgggttgaaaggaaatggaagatgggattgagagtgaataaaagatcagcagacggactggtggagaaggaagaagtggagaaatgtgtcagaatggtcatggaaactgagagaggcgttgagatgagggagaacgcttcacagtggaagacattagctagggaggcaatggcggaaggcggatcttcagacaaaaatattgaagactttatcgaggagattgctgccaaatcgttgcggatatctggttcgggtgttccgatttgacaatagctacaagggaggaaatttagtgatttagaataaaaataaatacaaatgatgtttcatgtatttcgcttcagtagctgaattattttggaccatcttttcttctatatcaggtttattacacttaccttcatagtacgttaacgaaattgtgttgagcgcaaaaaattgtctgatcatttatttatgtttgtgagaaactttggcactgattataaaagctttggtggcattcatcttatgaatgccagcctctaatagaacaatgcttatttatttgtctgtaaaaaaaaaa

SEQ ID NO: 31 - DNA, 1871 bp, Pinus radiata
cgagccactaaggagattttgagtatttgaggagtttgtgtagtaatttttgagtcctagtacagcaatgggatatttacaggggttggattacagcatgcttcacgttctggtggtgccctttccagggcagggtcatatcaatccaatgctgcagtttgccaagagactctcctccaaaaatctgcaggtcacctttgtgactacggaggcaaatcgtaagcggatgttacagtcgcaagacacaacatccgaagcatcagacaagcgtggggaagttcggtttgagacaatctcagacggactgacttcggattccgagcggggtgacgtggtgattgtgtcggccatgttatacaaggttggaggattgatgttgggaaatctggtagagaggcttaacgctgagggaaaccagatttcttgcatcgttcaagattcgtttcttccttgggtttcggatgttgcaaagaagtttaatattccttcagtttttttctggacgcaatcttgcgcagtttatgcgttttatcaccattctgtctatggaaaactcgctacctcgttggacgggactcagaacgaagctgctgtagtagaaataccgggacttccaccggtgagtgtctctgatcttccatcgcttgtgcagccttcgaacccttacgggagtctgtggcaactcatagtggatcagtttaagtctcttcccgaggcgacgtgggtactcggaaattcttttgaggaactcgaatccgatgaaataaagtcaatgaaattggtagctccgatgcgaactgtcggtcctctcataccctcagctttcttggatggacggaatcccggtgacaaagaccctggtgcacagttgtggaaaaccacaaactgcatggactggctgaatacgaaggaatccgcaagcgttgtctacgtttccttcggaagcctgtcggttctttcaaaagaacaaaatcatgagattgcttttgggctgaaggccagtggatattcctttatttgggtcatgcgtccatcttcttccactgggaacgttgacagcgacgaaaactttcctgagggtttcctgaacgagacctcggaacaaggactcgtcgttccatggtgtccacagctggaagtactttctcatgagtccgttggtgcatttatgacgcattctggatggaattcgacgctggaagggctcagcttgggggttcccatgctggctgttcctcagtggagcgatcagacaactaattctctatacattgcagagaaatggaaaacgggattgagactgactaaacgatcagctgatggactggtagggaaggaggaagtggaaaaaggtatcaggacagtcatggaaactgagagcggcatcgagatgaggaagaacgctctacggtggaagacattagcgagggaggcaatgatggaaggggggtcttccgacaaaaatattgaagactttgttgaagagattgcccacaaggtgcggctgttttgacttcatgaggctatatggttggggtccgggcaagttcgatgtatataattaagactacatacatgaacgttgtctcatatataaaagttaaaacattacatcaattattttgatgtaagtagcagcccatttccggatgctattcacattaatgaaatattatcaattatgaatttcatcgagtacaaatatttgttgggtggtagttagaggggctggtgagtttgcttttgctaaaatcataggaacttagtatactctacttataagtggttggttatgctcttagtgttatagtgacagttataagcttttatcttgagtctctcttagattcaccatgtagttaaaaaaaaaa

SEQ ID NO: 32 - DNA, 1701 bp, Pinus radiata
ggtcgacaaatatggatgagtgtgaaggcaaaactggtatgcatgccatactcgtcccgctgccggggcaaggccacatcaatcccgcaatgcagctcgcaaagaaactcgcctccaaaggcattagcatcacatttgtcctaacacagtcatggcataacatcatcactcacgctcattccaccaagggttccaatgcattcaaccacgctcagaatcttggcctcgacattcggctggtggcaatacccgattgcttgcctggcgagttcgagagatggaacaaaatccaagagttttttcggtccctggataacatggaaagccacgtggaggagctcataaagaatctcaatcaatccagtgcagcccccgtctcctgcatcgtggccgacactatgcttggctgggctgtgcctttggccaagaagctccgcctgctgtccgtttccttctggacgcagaatgtgtcggtcttttccatcacttacaattcatatttagaggaacgtcgggcggaatcggtaattcatattccaggtgtgacccctttacagcccgcagatcttcccttctggttaacacgaagcccagataatgtaatcgccagagtggttgctcgctgttttcaaacagtcagggaagcagactgggttgtagccaattccttccaaggcttagaaggtcatgtagtggaggctttgtgggagaaaatgcgagtatactgcgttgggccattgctcccttcagcgtacctcgaccgctcagatcctcgcgactctgttgtggggaccagttatcgggtagagatggactgcacacgatggctagacgacaagccccccaagtcggtcatatacgtctctttcgggagtctactccccatgtcgaaaagccaaatagaggaaatagcaatgggtctgaaggagagcgattatagttttatttgggtgcttcgacattcgagcaaagagtgcaccgaagtctcatccatgctgccggatggctttctgaaagaaacaaaagagcgaggagtggttgtgccatggtgttcacagctgaaagtgctgtctcatccatccatcggcgggtttttcagtcactgcgggtggaactccactttagagagtattgctttcggcctccccattctgggatttcctctaggggtggagcaatttaccaactgcaacctcatagccgatgaatggaagattgggctgagactaaggagcggcaatgatacagataaggttattggcagggtcgaaatagcggaaaatgtgaagagattgatggaaggggaggagatgagaagggcggccgagagactgagggatgttgtaaaaatagaagtaagggaaggaggaacttctgacagtaatttggaatgtgttgtggaggggttaaatgccaaactcagcgaaaacaagatattatctacatcttcgcccaatggaatattgtgagaagagactcatcaaatgaatgcattatgctgtgtaatctaaaatttgatggtgtcctaagttaatgaaggtctcagaattccgtatagtagacttcaccaaggtcgtagtcagtcatggtagaagagacgagattcatcaaggtcgtactgtaactgtaactgttttatgtttaagaggattttttttagaattttacatcaaatttattggaattggactaaaaaaaaaa

SEQ ID NO: 33 - DNA, 1993 bp, Pinus radiata
attctggatgccataattgatggaggaggatcttacactttggtgcagaagatgagctaaaattgaaaccacagacttatggagactatatgttccatatatagaagatacacttttcttttaaattcagggtgtttctgccaatctaccccatactcaatcctatagcttctgtgcatctttgcagtcgagtcgataaaggagccacacaactaaagccggctcggagcatggagaatgaaaatggaaggagggctactcatcctcatgtgatgatgctgccgtctctgggtcacggccacctcattcccttcatgcacctcattcccttcatgcacctcaccaagaaactcgccaccaggggcttcacggtcaccttcgtcgtcacatttcatcacaagtcttcactgctaaagaaggtggaggccgcgcgggagacggggctggacatccagatggtggaaatggaggtacccagagacgacttggcccttgggaaagtcaatagcaacagcacccggctgaggcatgagctacctcctttactcgcagccaacgaactcatggagagctccttcgaacgcttcctacaacgatttatgggtggcagattctgctccaccggccctccactcagctgcctcattgctgatatgctcctgggctgggcctcggccgtggccaaaaaatttaatatacccacagtgtgcttcctcataggcggcatgtactcaaatggtgtcatagtgagtatgtccgaggttctgcctcgtaatcttcggcgcacaccttcaggtcgatatattgtaccaggacttccaaaggaagtgcgtctcaccgggcttcagatgctgccggaggcaaccgagttgacgacggagagcgcgattcatcaattcaatatccgcgtgatagaaggcaacgatcagagctggaggttcatcgccaatactttctatgatctcgaggcggatttcgtggagtatttccagaagcgtggcagcagcatcgtcgttcgaacaataggccccctcctccctccggaggctttcggaaactcacccaccaaaatcgatccgctggtggaaatgggagtaaataaggagtcagaggagtcagaggagtgcttggactggctcgacaggcagaaggaggagtctgtgctttacatttctttcggcagcgagaactccatttcgagcgctcagactgaggagttggccatgggtttggaggccagcagggtaaagttcgtctgggttctgcgaataccgtctgatgcaggatccaagtcgttctcgtcggcgctcgattttcttccccagggattcagaagtcgtatggtggaggaggagaagcaggggttcatcgttctcgggtgggcaccgcagttgagcattctggcacatcctgccatcgccggctttctgtcccactgtggatggaactccgtgctggaaacgattacgatgggcgttcccatgatctcgtggccgctcttcgcagatcagtactacaactctaagtttgtggtcgatgagatccagatcgcgctggaggcgccaaagagaaccgaacaaaactggctggtccctagagatgaagttgaaagaattgttaaacttctaattatgggagaaaggggcagggaattgagaaaaagagtgagggaattgaagatggctgcgagggcagcagtggcggagggagggtcttcctacagcaatttcgacctctttgtctctgaaatcatgtccctgtctctgtaagttcaagaatacaactccttatgcattactgcaactgtcatctcatcccttcccttagtgtagcacttgtaatctttgtctgtgtcactgtgctttaaatagaaaatggatggtagttatgtttgatagctgtaactgcacctgttaactcatccattagtatagcagttgtaatttttggctgtgccataattcagaattcagatttgaacttaaaaaaaaaa

SEQ ID NO: 34 - DNA, 1712 bp, Pinus radiata
atttcaggagcaaagagctaattgttatctatggctccccatgttttggttataccatacccagttcaaggccacataaatcccttgatacaactctctgagatgctttcttccaaaggcattcttgtcaccttcatcaacaccgaatgcaatcattccaaaatgatgaaagcccgcagttatcacgactggaattcagttggtccgaattcaaacattcatttctcacaggtttcagacggtctaccgctggattttgaccgcgcggccaattcttcggaattttaccgatgtataaggaacgaaatgagagactctgtggaaggtctgatacaaagtcacctcaatgcagaaacgggcaagcccccgttctcgtgtattatcagcagctcctttcttacgtgggcctttcatgtcggcaagaaattagagcttcctttcatcgcattctggtcgcagtctgtcagtgtatataccatctacagacatctctccatgatcatttccaactgtcactttccgcctaaaaaagaagatcccaaggacataattgactacattccgggtcttcctccattgcagcccgaagatctgccccaagatatccagacgggagatgcctcgagtggattccatagacttgttgtggaacagctctctttactagaagagacagagtggattatcggaaatacagtgtacgaactggaaagagaagcaagcgatgcagttcaagaagcagcagctccaatctgctcactcggtccgtttcttccatcagtttatctggaatccgagtgcaagcataaggagatttctgtgaattccacgtcattaagtctgtgggaggaaaaggattgttcgcagtggctggattcgaaggcgagatcttctgttctctacgtttcctttggaagcctagctcgcatgtccaaaactcaagtggaagagatagcgatgggtttattggaaagtgggcagaatttcctgtgggtagtccgtccaggcatgttaggttctgatgatgatggcgacgttctaccagaggggtttttggagaaaaccaaaaatcgagctctgctgattccgtggtgtactcaattgtcagttttatctcatccttctcttgggggtttcttcacccacggggggtggaattcaacgttggagagcctgagtttgggggttcccatgttggtttttccacaggcgactgatcagtacacccatagaatgctcgtggttaaccagtggaagattggattaaggttagcgaagtgtagggacgatggagtgattgagcggggagagatttcaagagctgtcaaacttctggtgggaagcaaagaaggggaagagatgaggaggaagagtaaagaaattagagaaactataaggcaaacaacaagtgaaggaggatcctcttggattaacatgcaacgtttgctcgattatattggaaccacgagcactgaaccagttagatcagaaatatgaacagtgtcaactctcagagaatctgacgaactataacggcttcctaaaatttgctaaatattacttgtatttcttcaaaattatttctgtgtccatcgtgaattctttgacttcgcataaaataggaagaagcggagaatggaatttccaaaatatttatggttattatgtatattttatcttaagctgttggtaaacttgttttaaaaaaaaaa

SEQ ID NO: 35 - DNA, 1668 bp, Pinus radiata
agtgaataaaaactcaacgaccacagagtggtgctccaaggatcagatggctcacaatagcgaacctttacatgctctggttattccacaccccactcagggtcacatgaatcccatgatgcagttcgcaaagaatcttgcttccaaaggtctcagtgtcaccttcgttaccacccatcacacacaacaacagatcattaaagctcattctcagactgatcaagtcgatcctattgatgcccacaatatggatggtgatattcgctctgctcagatctccgatgggttgcctctcgatttcgatcggtccgctggattttccgagtttatgcgcagtgtggaaaagatgggaggagagttggaacgccttattcacgatctcaacgagacgggacctccggtatcgtgtgtcatagctgacacaatgcttttctggtcactgcaagtaactaagaaatttggtattccctggatttcgttttggacacagccgacagttgtttattcaatcttctatcactcacatcttgtggaggctcaacgccaatctcatgataaaacgtctggtgatgaggttgataatttgattgattatattcctggcgttccaacgttacatccaagagatcttccgtcattcttcaatgaaacagacgccgattcactatacttacttgatttgtttcgtaagtcccttcagtcaagtcgcgaagctgattgggttctctgtaattctttcgacgatctcgaaagtgcgacagtgaacgcttcaatgaaattagaacctccagttttccgtgtgggtccgctgcttccatcaggttatttgaaaggtgaaagtcctgatgagaacatgcgcactggaacaagcctttgcacggagcatgactgttcagagtggctcaatacaaagcccaatggttctgttatatacgtttcgtttggtagtttgattcatgtgtctaaagatcagctaaaggaaatagcgatgggtctcagggacggcagacagccctttctctgggttctgcgtcctgacatagtagcttcaacagtctcagatctcttaccggatggttttctggacgaggtgggaagccagggcctcgttgttccatggtgcaatcagttgcaagtgttatcccattcctctgttgcgggattcattactcattgcggctggaactcaatgcttgaagccatagcccttggagttcctatgttaggatttccattttgggcggatcagttcaccaactgcaaatttatggccgatgaatggaaacttggattcagagtgagcggagtggctcacggagaagataacagaatgatagacaggaaagacatatccagcgctatcagaaaattgttcaccgacgaagggaacgagatgaagaaaaaggttgcagccataaaagaaagtgcgaggactgcagtgcgaacagggggatcctcagacaaaaacatggacagttttataatgggtttgaaggcattaaatgctaaacctcagggaaagcaatactgaatactgtcatctatagctctatccatgccgtagtttcacctaagcattgccctatttttaatagtagcttatctgtattgccgatttgattccagagagcattatatatttactgctattttgcattaaaaaaaaaa

SEQ ID NO: 36 - DNA, 1630 bp, Pinus radiata
cgactatggagagcactggaaattgtggcggctttcacgccctagtcgtcccgctgccgggccaaggacatatcaatcctatgatgcagctcgcaaagaagctcgcctccatgggaatttccattacatttgtcctcacaaactcatggcatcaaattatcactgacgcccatttcgggcacggtgttgatgcattcgcccatgctcgaaatcttggcctcaacattcggatggtggctatacccgattgcgtgcctggtgaattcgagagatggagtaagatccaacagttttatgggtcgttgggtaacatggaaggccctgtggaggagctcatccacgatctccatcggcaacccaatgtaacgcccgtctcctgcatcgtggccgacacttacctcacatgggcagtgcctctggccaagaagctcaatatgctatccatttctttctggacgcagagtatctcaatgttttcgatccttcaccattccgaattagaaactttccaggcgggatcggtaattcacgttccaggtgaaatctccatacagcctgcagaacttgggtcgtttttgaaagaccctgcaaacaccagagctgttgttcagtgtttagaaagagccagagaagcagattgggtagtagccaattccttccaagcgttagaaggcgatgtagtggaggctctgtcagagaaattgcaggtatactgtgttggcccattgctgccttcggcgtacctcgatcaatcagtctctcgcgacttcgttgtggggacgagctcgcgggtagagatcgactgcacaaagtggctggacgaccagcgtcctaagtcggtcatatacgtttcgtttggcagtttaatcaccgtgtcggcaaggcaggtagaggaaatagcaatgggtttgaaggagagcagctactgttttatgtgggtgctccgacatcccggcccggaggccaccgaagtctcagccatgctgccggagggctttctgaaggaaacaaaagagcgaggactgattgttccatggtgctcacagctgaaagtgctcaatcatccctccatcggcggctttttgagccactgcgggtggaactccattttagagagcatctcgtcgggcattcccctgctgggattccctctagggaatgaccaatacaccaactgcagactcttagccgatgaaaggaaaattggactgagattgaagagtagtaatgatactgaaaaggttgttgggagggaagaaatagcagaaaaagtgaggagattgatggaaggggaggagctaaggaggacggcagagagactgagagatgtagtgcagatggaagttaagaatggaggaacttccaacaaaaatctggaaattgttgcaaatgggttgaagaccaaactcatgtgacgcagagtgctggcagatctgaatatcgattttctaatttcgatctctgtgtcaacggtctcaggtttcatggtcgaggcagtgagaaatgcctcactcactgtttccaataaataattgacttggatatatggatcggtttgccaaatgtttgaagtaagaaaaataatttagggttactctaccataaagaaatattattgttaaaaaaaaaa

SEQ ID NO: 37 - DNA, 1769 bp, Pinus radiata
ttacgagaagttgtataccgaatatacagaaaggaaatcagttgcagctcttgcattgcagacatggaattggagaagagaagtattaaggcgcacgtcatggtattgtcatacccagcaacgggccacacgaatccaatgttacagttctccaagaacatcgcctccagaggactgctcgtcacattcgttacattcagctacaatcatcacaaagtgatacaagccaaggactctctgcgacgacttaatctccctatacaattcgaatgcattccagacggccttcctcaagaccataccctcgattcaaatgtcaacaacgtcgttttcaatcatatgcgcaacaacatggacggctccacattggagaggctcatccaccgactgaataccagagggaatgctcctcccgtttgctgtatcgtttataacccatttcttccatgggctcgacaagtcgcaaagaagatgaatattcctcatgctttgttttggacacaatccactgcactattctccatctattatcactttaataattcttcaggagaaaagtgggattcaagacaaatggcagagagcgtgagcgtttccattccgagccttccagaactgaaattgggagatttaccttcggcattcacagatacagaggaaagactgcagatttatctccaccaattagacggtctcagcgatgtgtcgtgggttctcgcgaataccttttatgaactggaagcccagacgatcgacctaatgagatcaagatttggagtgccatttagcagcataggcccttgcataccctccgcttttctggacggacgtaatccgcatgacgcccgagtgggtgcagatccgtggacggcgacggacaaggtgcaggagtggctggacaggaagcccccctcctccgtagtatacatttccttcggcagcatcaccgtcataaacccgcagcaaatccatgagttggccttgggaattgagagcagccaacaaaatttcttgtgggtcatccggcctcctcccgggcacgacgacattacggaattttttccggcaggcttcgtggagaaaacggaaggccgtgggctcgtggttagctggtgcgttcagctggaggtgttgtctcatcggtctgttgctgctttcatgagccactgtggctggaattccactctggaggccttgagtttgggagttccagtcttgaccttgggtgtctggaccgatcagaccaccaattcgaaattccttgcagatgtgtggaaggcgggagtgagaatgagaaagggagaggatgggactgtgggaagggatgagatcgagagatgtatgagaatggccgttgacaagaggagtaaagcgggagaagaacaccagaagaatgctgtgaaatggaaacaattggcgaaaagtgcgatgaatgaaggcggttcttttgatacaaatttgaacgaatttgttgaagacgttgtttccatagctacacgatccttccctcccccgtcctaggagggagttaaatttcatagttcgatttccacttagatagatagtttaatgtctacaatatgattctttaatagtaaataacacacccatgaaacgccattattagtcgccgcggtaggggccgctgcgactattgtaatcgatacggccgatgttagtattacttgagcttttccgctgattagggataatcaaacgttttagttccatattaatttaatattttatttggttttttaaaaaaaaaa

SEQ ID NO: 38 - DNA, 1642 bp, Pinus radiata
cagttgagtaaagaagagaaagaataaggtactgcatataatgagtattgaaaacgtcgattgtgctttgcacgcagtcattgtgccatttcctgctccgagtcatgttaatgctctcatgaatttgacacagttgctcaccaatcgtggattttttataactttcgtcaatactgagtggctccataaacgcatagtccaagtctctgcaggaaacaccaattctcttatttccagtgagttggagcaacgaaggtccaagattcgttttctctgtattcccgatggcttaccgcccgaacacagccgtctctccaacctcggcgaatatgtgcgtgcaatgcaaaagttgagccctgcattggagcaactcattcgcagcagcggcgctacaggtgatgatggtcaatattcatttccacccatcacgtgcattgtcacagattgcttcatgtcttgcacggatcaagttgccacgaatatgaaagtgccgagggttatcttctggcccttttgtgctgccgcttcgatttgccagctctacactcaattcctcgtgtctcagggacatattcctgtcaaaataagcgaagcgaacaatccaggtaaagtgatcacttgtcttccgggtaatctcccgccaatgaggccaactgatctaatgtacttatatcgcgctgaagatcccacagacattcttttgaatgctctcgtgtatgaatcagagaagcaaagaaaaggggactacgtgctggtgaacacttttgaggagctggaagggagagataccgtaacggccctgtctttgaatggatgtcctgccctcgcaataggacctctatttcttcctaactttttacaaggaaaggattgcaccaccagtctttgggaggaggacgaggcgtgcctctcatggttggatatgcaacagacagcatctgttatatacgtttcctttggcggcctggctatcaaatctcaggagcaactgcaacagctggcgctagggctcgagtgtagcgggcagcctttcttgtgggttcttcgctcggatattgaagatgggaagcctgcagttttaccggatgggtttgaagaacgaaccaaaggtcgggcactgcttgtaaggtgggcgcctcaggttaaagtgcttgcccacacatccgttgggttattcctcactcacgccggctggaactcgactttggagaccataagcatgggagttccggtagtaagttttccttattttgccgatcagtatctcaactgcaggttcgcgaaggatgtgtgggagatgggcctggattttgaaggagtggacgtggatgaccaaaaggtggtgtcaaaagaagaggtggaggatcgtgtgaagagaatgatgagaactaaggaaggaaagcagttgagagagaacgccgtgagacttaaggagtgtgcaaggcgagcagttgtccatggaggctcatcttttaataacttaaacaccttcgttaatgacatggcaaggaaaaccacagctcgatcccagaacgaaaccaagtgaagtaatctgaagaatgcgtattgattccagatgttgcgtgctgggatttcatttaagcgcatgattaattcttaataaattccgataaaaaaaaaa

SEQ ID NO: 39 - DNA, 1713 bp, Pinus radiata
agaaagggcagattaattgagaaggccgagagtcgcgagaacgatatacttgtatcgaaagttgtctgcagctattcctttctgggggctagtaagatgggatccttaggagaactagaatacaacaagcctcatgtgctcgtgatgccttatccagcacagggccacatcaatccaatgctactatttgcgaagaagctcgcctctaaacaaatgatggtcacgtttgtgacgaccgaagaaaagcgtgtgcgcatgttacaggctcaagattcactgcccggggcgtcaaactcctctatggaagttaagtttgaaacaatttcagacgggcttcctgtggatttcgaccggtcgaaggacgtggacatggtcctcgacttgttatccaagatgggaggactcacattagcaaatctcatagagagactaaacgctcaaggcaacaatatatcttgcattgtttacgattccttccttcactgggttccggatgttgcaaagaagtttaatattcctgtagcatttttctggacgcagtcgtgtgcggtttactccatctattacaactttagcggaggattggccaacttgcgggatgagacaggtaaaacagtggacgcaatagaagtaccaggactgccgttgcggaaggtatcggagttgccatcgtttctgcatccttcaaatacgcaagagtcccttttgcgattagtaatggatcagtttaagcttctttcagaggcaacgtgggttctgggaaattccttttccgaactggaatcggaagaaataaattcaatgaaatcgttagctccgattcgcactgtcggtcctctcataccctcggctttcttggacggacggaatcccggagatacagaccctggggcacacttgtggaaaaccacgaactgcatggattggctgaatacgaaggaacccgcaagcgtcgtgtatgtttctttcggaagccttgctgttctttcaaaagaacaaatgcatgagattgctcttgggctgaatgccagtggatattcattcctgtgggttgttcgtccaccttcttccaaatgggaaattaatagtgaagagaacttgcctgcgggcttcctgaacgaaacctctgggcaaggcctagtcgttccatggtgtcatcagctgcaagttctttctcatgcgtctatcggtgcttttatgacacacagtggatggaattcgacactggaaagcctcagcctcggggtccctatgttggttattcctcagtggagcgatcagtcaactaattccgcatacgttgcagagaaatggatggtgggcatgagattgaaggaacgatcagaaaatggacttgtagggagagaggaagtggaaaaatgcataaaaatcgttatggaaagccaactcggtgctgagctgaggaaaaatgctttactgtggaagaaattatctagggaggccatggtgaaaggcggttcttccgatcgaaatattcaagaatttgtggatgaggttgttgcccgagcatggtcatcttcgttgtctggacaagattttattgtttgattagactgcaatccgccattccacacaaaaatttgtagaagttagactttcaagaaagttgtaagctattccattgctttttgtaattatcacagtgaaagaatttattaattcttgcaatcatttcagtacccaaaaaaaaaa

SEQ ID NO: 40 - DNA, 1814 bp, Pinus radiata
agcagtggtatcaacgcagagtacgcggggatgtatcgttatattggtgactttctgtggtaatcgcttggggttagagcttaggagaatggaatcttcaggggggctcctgtacagcaatcttcgcgttttagtggtgccctatccgaggcagggccatatcaatccaatgctgcagtttgccaagcggctagcatctaaaaatctgcaggtcacatttgtgacgaccgaagagaaccgagagcgcatgttacgggcgcaagatgcagtgcccaggccgccaaacaagtctgtgaatcttcagtttgagacaatctcggatggacttccgctggatttcaaacggtccaaggaccgccagatgaggttcgacatgctgtgcagaatgggaggacttacgttagcaaatctcattgagaggctaaacgctaaaggcagcaatatttgttgcatcgtatatgacgccctcctttcttggcttccggaaatcgcaaagaaatttaatattcccctcgcttttttctggacgcaatcctgtgcagtttactcgatctattaccatttcaagagaggactagcaatcacgggagacggaacagagaagccgacggacctgataaaaatacccggcttgcccctgctgaaagtatcagacttgccgtcatttgtgcaaccctctaattccgatgggtttctctcgcggatttttcttgatcagtttaatagtttatctgaagcaacgtggatactgggaaattcgtttgagggacttgagtacgaagaaattaactcgatgaaatcgatagctcctattcgcaccgtcggccctctcataccctcggctttcttgaatgtacagaatgacgacgatacagacttcggcgcagatatgtggaaaaccacaaactgcatggattggctgaatacgaaggaaccggcaagcgttgtgtacatttcctttggaagcatcgctgttctttcggcagaacaaactgaagagatagctcttgggctgaaggccagtggatattccttcatatgggtcattcgtccatcttcttctaatgaggtgattaacagtgaagaaaacttgacggagggtttcctggcggaaatatccggacaagggttagttgttccgtggtgtccacagctccaagtgctttctcatgcctccgttggtgcatttatgacgcattgtgggtggaactcgacgctggaaagcctcacgatgggggtgccccttttggctgtgcctcaatggagcgatcagacaacgaattcacggtacattggggaggaatggaagacaggactgagattagataaacgatcagcagacggactcgtagggaaggaggctgtggaaaaatgtataagaatggttatggaaggcgaactgggtgctgagctcagggagaacgctttacggtggaagaaattatcaagggaagcaatgggagaaggcggaacttccaatggaaatattgaagaatttgttaaagatattgttggcagagcatcgtcatcgtcattgtcatccggttgatgtgatcatggattcctaaatgaataagagggcactgcaattcagctagtcgctgccttgctttaaggaaaaggtggatatgcgcatagtaactgagggagcaactttgacgttaattgcacttcctcgttttatatttatttgcacttcattttatcagtgaaggcaatagcgaaaaacagattttggtttacgttttgtaatccatattgttgctcaagtaaaaatctagaaaaccgattttgattgtggtcaaaaaaaaaaa

SEQ ID NO: 41 - DNA, 2123 bp, Pinus radiata
gattttcatagtttataaaattttgagatcgaagatgttgctctgcgcttgcccaggtgtgaagtactggttaattgtcatcctgctaatggtgattcagtacctggatatagcagcaggaaagcatgaatctacaaccaggcattacaagttcaacgtgaggctaaagaacgtgacacgtctttgccactcaaaacctttggttacagtcaatggacggtatccaggaccaacgatttttgctcgcgagggagatcgggtcattataaaacttgtaaaccacgtcaaggacaacgttactattcactggcatggggtccgacagctgagatctggatgggctgatggtcctggttatgtcacccaatgtccaattcaaacaggaaagagttacgtctataacttcacaatcacagggcagagaggaaccctatggtggcacgcacacatatcttggttaagagttagtgtatatggggccatcatcatatatcctaagctacacgttccctatccatttcccaagccacacaaagaagtccccgtcattctcggagaatggtggaatgcaaatactgagaaagttatccagcaggctcttcaaacaggaggtggtccaaatgtatctgatgcctatactataaatggacttcctggaccactttacaactgttccaatgagacatttgttttgaaagtgcatcctggacaaacatatcttcttcgtatcatcaatgctgcactcaatgatgaactcttccttgccattgcaaatcacagtttaacagttgtggaggtggatgcagtgtatgtcaagcctttccagacagatactcttcttataaccccagggcagactaccaatgttttacttactgctaatgctactagtggtaaaaataaacaatttgtcatagctgctagtccttttgttaccggttcagggacatttgataattccactgttgcaggaattgtgagttataattctcataagtttaaaaattcttccaccattattctgccaaaactcccatccttcaatgatacaaattttgcagccaatttcagtgccaaacttaaaagtttggctaactcacaattcccagcattggttcctcaaaaggtggacagaaagtttcttttcacagttggtcttggactgaatccttgtccagtgggggtgggaaatacgacatgtcaaggacccaatggaaccaaattcactgcctctgtcaacaacatttcatttgttctcccgagcacggctcttcttcaatctcactatttcaaccagataaaaggggtctataaaaccaattttccagacaatcctccattcccttttaattacacaggcactccacccaataatacaaaacctatgaatggaaccagagtaaaagtcattcccttcaatactacagttcaactggttcttcaagacaccagcattgctggcacagaaagccatcctttccatcttcatggtttcaatttcttcgtggttggccaaggtgttggtaactacaacgagtcaaaggatgcaccaaactttaacctcgttgatcctgtcgagagaaacactgcaggagttcccaaaggaggttggatggcaatcagattcagggctgacaatccaggagtctggttcatgcattgtcacttagaaattcacacatcgtggggactgaaaatggcatggattgtgaagaacggaaaaggaccccttcaatcgctccctcctcctccctctgaccttcctccttgctaatctgatctcatcacctttaattttcttaatggtcctttcattatggatgccattggattttcgattccatattcgatttgagtcaattgttgccagtaaaaaacgtaagtgggactgaaataaatgtttcctaataatggacacaataaaccgactgcggccaacctccggaacaaaggaaatctagcaggtacccagaaagaaacgaagatgtcaatctctagcttctgcagaggttgatcattctttaagtggtgcccgtcatgtattttacatgtatataatgtctatgtgagtgagtttgtaattgtgataaattatagtttattacaatttttcaaaaaaaaaa

SEQ ID NO: 42 - DNA, 2124 bp, Pinus radiata
ccagtgtcgagtgctgttacttgtcgctgacgattcattcgtttatttattcaaggacgttacttaggacgttagttagatatcattttgagggtttgcaagcgttgtgataatgtcattgcaaccagtatgtgctttcaggcttctttttctaatctcatttgttgcttgtttggctgccatcacaaatgcagacgtccacagatataccttcatcattgaaccgaagaatattacgaggctatgcaagacgtatgaattagtcgtcgtcaatggacagctaccaggcccaacgattcatgtacggaatggagacagtcttattgttaaagtttataacagagccaagtacaatgccactattcactggcatggagtgaggcagctgcgtacagggtgggctgatggacctggatatattacacaatgtcccattcaaccaggtggccgttacacatacagattcaacattactgatcaagtaggaaccttgtggtggcatgctcatgtgtcatggctcctagctactgtgcatggagctttcgtaatctaccctaagaaacaaagctcatatccctttcctaaaccccatggagaaactcctcttataataggagaatggtggaacgctgaccctatcgcggttatagacgaagcactccgcactggtggtgcgcccaatttgtcggatgcatataccctaaatggacagccaggagacctgtataactgctctagggcaggaacatttcggtttcctgtaaaacaaggagaaacttaccttctccggatggtcaatgctgcactcaatagtgcccactttttcaagatcgcaggccacaaatttacagtagtagctgtggatgcttcctacaccaagccatacaaaacagatataatcgccattgctcccggtcagactactgatgttctcgtcaccgccgaccaacctgtgggcagatactatatggctgcccgagattataataaccagggaacaggtgctttcgataacactacaaccacagccatttttgagtacgtgggacatcaaaatacacgtcccattttacctaagcttccatattacaatgacactgcggtcgtcactagatttagtacagcactgcgaagcctaaattccaaagacttcccagtggacgttccacatagcatagatgatagcctcatcgccacagttgggctgggattacttccatgtgaagctggaaacacctgtcaaggccccaacggaacaaggctcagtgcaagcatgaacaacatgtcctttgtattgcccagtgtcgccctgcttcaagcttattatttaggtattaatggtgtgtttatgagggattttcaatcaaaacctcctcttagattcaactatacaggggataatattcccaaaagactttgggctcctgaactggcaacaaaggtgagagttgtcacctacaactcaacagtacaactggtgtatcagagcacaaacatcttcgtggcagagaaccatccgatgcatcttcatggttacgattttttcgtggtgggacaaggtttcggcaactataacccaataaccgacccgattaagtttaatctggttgatcctccacggcgcaacaccgtgatcgctccagtaagcgggtgggttgccataagattcaaagctgacaatccaggagtgtggtttctgcactgccatttagacgaccatttagcgtggggattgaatatggtgttcctggtgaagaacggtcgcggtcctttggcaacattggagcctccccccgcagaccttcccaagtgctagagagaaggaaatatcaagaaccatagcagaatctgaacacattaaggggttggtattgatttaaaatctacggccattagtggcgtagttagagtcagcgatgtaaaatgtaaggccgttaaaggcgtagttaaaataatcgtcagacaggaaggctagctgtgtttttttactagtggggattgttgacggcatacatatataggttagggttgtcttttcggattgtcacttgggatattgaattccagatggaggagttttttttataataaaattggaataggaatttttggagaaaaaaaaaa

SEQ ID NO: 43 - DNA, 2048 bp, Pinus radiata
cttcaatgtttatatagtgaacgatattcgttcgatacgcttctcaggctttgcagaagcggtgatatatacgcatttaggatatcactagtttcctgcaacaatgtcattgagatcgctatgcccattttcagcgtggcttgtttttctatgctctttgattgcgtacttggctgccatcccaaatgcagcaatcgtcaattataccttcactatcgaaccgaagatagttaccaggctttgcaagaattatacagttgtcaccgtcaatgggcagctaccaggtccaacgatttatgtacatgacggggacactgttattgttgaaacttataacaaggccgagtacaatgccactcttcactggcatggagtggagcagttgcgtacaccatgggctgatggacctgcgtatgttacacaatgccccattccaccaggtggtcattatacatacaaattcaacatcactcgacaagaaggaaccgtgtggtggcatgctcattactcatggctccgtgccacggtgcatggagctttcgtaatgtatcctaaggagggaagctcatatccctttactaaaccctatgccgaaattcctattataataggagaatggtggaacgataaccccatcgcggttatagacgaagccattcgcacaggtggtcagcccaatatatccgatgcctacaccataaatggacagccaggagatctgtttaactgctctacctcgggtaacaagttgttctttctcaaagacttctgtactcaacttctataaatggctgtgttgaaattgatcgaagaattgtggatgcaggaacatttcggctctctgtaaaaagcggacaaacataccttctgcgtatcgttaatgctgcactcaatagcgggcactttttcaagatagcaggacacaaaattacagtagtagctgtcgatgcttgctacaccaaaccctacaaaacagatgtacttgtcatctctgccggccagactacagatgttcttataacggccaaccagcctgtgggcaaatactatatggccgcccgagcatataacaatcaggcagcgggcgatttcgataacaccactgctactgccattctagagtatattggagctcaaaattatacaagtccaattttgcctagccttccagcctacaacgacactgatacagtcactatatttagcagagcactgagaagcttggcttcccaagaacacccagttgatgttccgcaaactatagatgaaagcctcatctccacagttggactggggttgcttccctgtgaaactggaaacacctgtgaaggccccaacggaacgcggctgagtgcaagcatgaacaacatatcgttcgtagatcccacgatctcgctgcttcaagcttattattacaacatcagtggtgtctatatgacggattttccatcaaaacctgcagtaagattcaactacacgggagacgatataccgcgaaaattttggattcctgatccggcaacaaaagtgaaagtgctggaatacaactccacagtgcagctcgtttttcagtcaacaaacatcttcgtggcagagaaccatccaatgcatcttcatggttacaacttttacttggtgggagatggctacgggaactataacccagacaccgaccagaaaaagtttaatctggtcgatcctccactgcgcaacacagtaatcgctccagtcagcgggtgggttgccataagattcaaagcaagcaatccaggaatgtggtttctgcactgccatttggacgaccatttcacttggggattgaatatggtgtttctagtgaagaacggtagcactccttcctcaacaatagagccccctcctgcagacctccccgcgtgctagagaatgaacaaaagtgatcagggcaaaaggcatcctgtggctgtcatcaggagctgccctttccactaagaaagattttataatatagtgtgatcagttatgtcgtggaaatcaaatcaggtgtgacattctaaataaaaaaaaaa

SEQ ID NO: 44 - DNA, 2090 bp, Pinus radiata
ctaattcattcacacagctcaacatgatggcgcccatggccggagcagagtacggaataaagctgattattcagttgcttgttgtactacttgctgttcaacttgttgcagggaaaacgaccagacattactcattccatgtgaggttgaagaacgttactcgtctctgccacacaaagccattgattacagtcaatgggaaatctcctggacctaaagtagtcgtccgtgagggagatagagtcatcatcaaagttcataatcatgttagcaataatgtctcaattcactggcatggagttcgacaattgaggtctggttgggcagatggccctgcttacataacccaatgcccaattcaaacgggacagacttatgtttataacttcactgtcacaggacagaggggaactctctggtggcacgctcacatctcttggctaagagcgagcgtatatggcgctttcatcatctatcctaaacgccatgttccttatccatttccaaagccatacaaagaagtccctctgattctcggggaatggtggaatgcagatactgagaaagtcgttaatcaggctatgcaaactggaggtggtcctaacgtttcggattgttacactatcaatggacatcctggacctctctacaactgctcagccattaatgatacattcattctgaacgttgttcctgggaagacatatcttcttcgaataattaatgctgctctcaatgatgaattgttcctaaccatcgccaaccataccatgactgtggttgaggtggatgcggtgtataccaaacctgtgacaacaaacaccattttgataacgcccggccagacaaccaacgtcttgctaactgcttctgcatcggactacaagggcaaacaattcttcatattagccagtccatatgcaacagggcaaggcacatttgataacactacacttgcagggattttgacctactctaaacatgtgcttttcaacacctctcatctaaattcttcgtctaattttaccaatgctctaatgccaaagctcccggtctttaacgatacctcttttgccaccaactttacccttaagatcaaaagcttagccaatgcacagtacccagccttggttccacaaacagtagatagaaagttctatttcacagtgagccttgggttgaatccatgtccaaagggtcagaaatgcaagggagtcaatggaaccaaattcactgcatccattaacaatatttcctttgttatgcccaccgttgctcttctacaatcacactacacaggaaaaatgaagggaatttataagaccaacttcccagataaccctcctttcccattcaactacacaggcaatcctcccaaaaacgtcacaactcctatgaacggaacaagggcaaaagtcatccccttcaacaccactgtccagttggttctgcaggacaccagcattgctggtgttgagagccatcccatccatttgcatggcttcaatttcttcgttgtaggccaaggttttggaaattataatgaaacaaaagattccccaaagtttaaccttgttgatcctgcagaaagaaacactgttggagtgccttcaggtggttgggtggccttaagattcagagctgacaatccaggtgtgtggttcatgcactgccatttagaagttcatacatcatggggactgaagatggcttggattgtgaaaaatggcaaaggaccctcccaatcaattcttcctcctccacctgaccttcctccctgctagaaaatatatattcatatcatgttatttaattcattcagtttgtatatctatgtattgcataagctgatctctgaagagtgcgacataagattaatttctttggtattggccataaccatcccactagtgtcgtatttgagaaatgcgtgtatatttgcataacctagcttgatcttcgaagagtgtgatataggttccatttccttggcattggccatgaccttcccaccacgattgtatttgagagatgtaatctacttctcttatcattattcaattttaaatttgttttatttaaaaaaaaaa

SEQ ID NO: 45 - DNA, 2029 bp, Pinus radiata
tttcggcttcgtactctctgcccggactttcagcaacacagaggtggtctgtcgaccttctatccacagtcttctccagcagtttgcaggatgagttcagatgccaatgcaacatcgtttcttacattcctcttgctgttactcaccattgaaattacagctgctgctgcaagctctgattacagcgttaaacgcttcgacttccacgtgcaatatcaaaatgtaacgcgcttatgccgcactaaatctctcctcacgatcaacggccagtttcctggaccaaccatagctgttaacgaaggcgattctgtcgaggtgaaagttcataatgatgcaaagtacaatatgacgattcactggcacggagtccgtcagcttggaacaggttggtcagatgggccagcatacataacacagtgccctatacagaaaggccagtcctacacttacaaattcaaggtggacggacaggttggcgcactcttttggcatgctcacatatcatggcagcgagcctcaatacacggagcattcactatctacccaagaaagggcgtaccatatccattccctaaacctgatgcagaagctcaaattctattcggtgaatggtggaacggggatgtggaggcaatagaagcatatgctaacaaatatggcggaggtccaaacgtgtcggacgcatataccataaacggccaacctggtttactctttccatgctctgctaaagatacatttgtgcaacacgttcatcacgggaagacgtatctactccggatagtaaatgcggctttgaatgttcagctgtttttcgccatagcaaatcacaccatgacagttgtggagatcgacgcgacctacacaaagccatacacaactaattacattctcttagctccaggccagacaatgtctgtgatcatggcaacagatcagcccaatgggaaatatataatggcagcccggccatacgttacatccgacgttccattcgacaacactacaaccacagcaatattacagtacgcaggatcatcaaggtccagttcggaaaatctccaaatcatgccaaatctccccgacatgagagacacggacagcgccacaaatttctcagccactctcagaagtctgaattctgcccaatatccctccatagtccccaagaaaatcgacacccggctgttcttcaccgtgggactcaatctccaagattgtccaccgggtgactcgtgtaaaggctactacgggggcagattttctgcatctgtaaacaaccagtcttttattcttccccaaaccgcgctgctccaggccgcctacaacaacaatagcggagttttcagccgagattttcccagcaggccacccttgcagttcaactacacggccaacaatctgtccatcaacatgaacccacagttcagcaccagggttaattgcattccctacaacgcaaatgtggagctgattttgcaagatacgggcattatgggattcgaaaatcatcccattcacatccatggctacaatttcttcgtagtcggtagaggatttggaaactataaacccactacagatccttcttcgttcaatctcgtcgatccgcctattcataataccgtcggtgtacctaaaggcggttgggcagctttgagattcaaagccgataatccaggtgtgtggttcatgcactgtcatttggaagtgcacacgtcctggggactggctatggcgtttctggtagaaaaagagggtggtctccgtcaatctcttggacctccgcctcaggacctgcctccctgttgattattttcttggaaatgttcttccctggtttcgttgaaccagtgtaccattacaaatgctgttctatatagaagtttgacagttctgctttccatgatgagcttcttggaagattgtactaaattcttgaagagcgggattgtcacgaattcttaatgtcaaggcggtgaacaaataacataacgatgatttgctttgctcaaaactaaaaaaaaaa

SEQ ID NO: 46 - DNA, 2274 bp, Pinus radiata
ggatgaattacttgggcgaggggctagcgttcattgactcattgaagcagttctgtcagctttgttatcggtggaagcattaacctgagagagtgaacagtttagggacgtcagggaatgatgaggatcagttcagccacgattctggctttggttgtatgcctgacctttctgactgtcacagctctggctacagatatactcagacacactttcgttattgaagcaaagcctgtgactagactatgcaagacgcatgatataattaccgtaaatggacagtttccaggcccaacgctgcatgtgaggaatggagacacacttgttgtgaaagtctataacagagcacagtataacgccaccatccactggcatggcatccgccagtttcgcacagggtgggctgatggacctgaatttataacacaatgccccattcgcccagggggtagttacacatacagattcaccattactgaacaagaaggaactctctggtggcatgcacacagttcatggcttcgagcttctgtgtatggagccctggtcatccatccgaggctgggcaccacttatcccttcacgatgccccatcgcgagactccaattattctcggggaatggtggaacagaaatcccatagatgtggtgaatcaggccacacgcacaggagctgcacctaatatctctgatgcttatactattaacggtcagccgggagatttatatccatgttcaaccagagacacatttcggctaccaatatacgacgacgagattcatcttctgcgcattgtgaacgctgcactcaatcaagaactatttttcagcgtcgccaatcacaagctaaccgttgtggccgtagatgcttcttatactaaacccttcagaaccaagtatgtgatgctgggtcccggccagactaccgacgtgattctccgcgcagccagacaccgtgtcggaacatactacatggccgcccgagcctattccagtgcgcagggcgtaccgttcgataacacaacgaccactgccattcttgaatacaggacccgggggctgccacggccatcctcatctggccccgtcatgcccattcttccagcctacaacgacacccgaactgccacgcattttgccagaggactcagaagcctggccaacatcgagcacccggtgtacgttcctcagaccgtcgatgaaaacctcttctacaccattgggcttggactcttcaactgccctaaccagtcctgtggaggtcccaacggaaccagatttacagcaagtatgaacaacatatcgtttgtcctgccaagcactttctccatactgcaagcccattacttgggcaggaaaggaatcttcaccacgggtttccctgataaccctcctgtgcagttcgattatactgcgcagaatgtgagccgcagcctttggtctcctgttaagggaaccaaagtgaaggtacttaaatacaacgcgaaggtgcaaataattctgcaggacacaaacatcgtcaatgctgagaaccatcctatccatcttcatggctatgacttttacattgtgggagaaggttttggcaactataatcctcgcacggaccctcagactttcaaccttgttgatcctcccatgcgcaacaccgttgctgttccagtcaatggatgggctgccataagattcgtagctgacaatcccggagcttggttgatgcattgtcacttggacgtacacataacctggggtttggccatggtttttctggttgaaaacgggccaacttacatgacaacaatagagacccctcctcctgatcttccagtttgctgaaagacctggccacaacataattcaataatcatgttgcaaattggaacatgaagttcttctgctcttccagtttgctgaaagacatggccacaacataattcaataatcatgttgcaaattggaacatgaaattctatttgtaggcgttctttattattatggttttaaacatttttttgccataactggcttgttccttgaatgtaaggtcacaggtccgtttttttttgcagaataaggcacaattgatcagatctgtttattcaaattcgagagaaagaataaacagagacttctatgcgcagctaaatataaatcaataggtggctgacacgtttgaattaccttcctattagtctcgagtatttcttggactaattccttgtaataatcaatattttcttaattgatatgttatccatttgcccaaaaaaaaaa

SEQ ID NO: 47 - DNA, 2119 bp, Pinus radiata
taacttgtaagtttgccaccattgttggatgcgccctgttcagggttcagttttcagtcgcagtagagtaaataataaaccaaagaagtgagaaattccaccccatgatatgatatgtgatggcttgctttgttaatagaacgtcgtttctctgtgcttgcgccgccttcgttttgtcgttgctcgcggtgattagatatgcgcaatgcgccgctccaagtcgcaactcaaaatttttcgaattccatgtgcagtaccagaatacaacccgcctgtgccagtccaagcctcttctaactgtgaatggacagtttcctggtcctacgattgcagtaaatgagggcgataatgtgatcgtgaaggtcactaatcatgtaaagcacaataccacaattcactggcatggggttcgtcaatttcggacaggatgggctgatggtccagcttatattactcagtgtccaatacaggaaaggcaatcctatacctacagattcaaggtgagtgaacagaggggtactctgctttggcatgctcacatctcatggcaacgagcatcagtccatggagcatttattatctatcctaagcaaggcgttccatatccatttccaaagccggattttgaagtatctattctactcggtgaatggtggagcggtgatccagaggctgtggaagcagaaaccatgagattcggcggtggtcccaacgtgtctgatgcatataccatcaacggacaaccaggcctgctctatccatgctctgataaagatacattcgttcaacgcgtggatggtggaaaaacttaccttctccgtctgatcaatgcagcgttaaacgatgagttattcttcgccatcgcaaaacacaatttcacagtcgtggaagccgatgcttgttatacaaaacattacactaccgactgcataatgataggtccaggccagaccatgagcgttctcatgaaaaccgatcagcccgtgggaaggtatatgatggctgccagaccttacgtaactgcaagcgtacccttcgacgagaccacacctacagcaatcttggaatacaaactgcctgcacaatccttgcagctcccaattatcttgccagatcttcccgccatgagagatacatactatgcaaccaaatttgccacagccttgcgaagtctcaattcccgagagtatccctcaaatgttccccaaaaaatcgatcatcatctgttttttgcagttagtctgaatctccaggactgtcctgttgatagcacctgtaaaggttactttggaggcagattttctgcatccataaataaccagtccttcgttcatccaaagacagctctgcttcaggcggcatactacaatatcagtggagttttctctaaagattttccaagcagaccgccccatgaatacaattacacagcgcccatctcggcagcgcagaacatgaatcccaacttcagcactcgagttgcagtgattccttacaacgcaaatgtagagctcattctgcaaggcacaagcatcatgggctttgagaatcatccaattcatatacacggattcaacgtgtacgttgtggggcaaggatttggaaattacgatccaaatacagagcccgcttcttttaatttggtagatcctcctttacggaacacagtagcggtcccaacgtcaggatgggctgccttgcgctttaaagctgataatccaggtatatggtacatgcattgtcatttggaaatacacacgacttggggtttgtctatggcttttctggtagaaaatggaactggtctggcccagtctgtacttcctccgcctcctgatctgcctccctgctaattaatgtctattcatactcctgtttcagaacactgcaaagactgtaaatctatccataaaagtgccaaaggtaatataaatgttcttaaacatggcactcactagttgcttaagaacatatcgtttctctactttttggcattggcaatatgggattacctggttgatagtagaggaaatgggttcaccatccatgcatttgtaaccaacacttcggtcaagtcatcacaagtccggtctgctaacaccgacatagaaaaaaaaaa

SEQ ID NO: 48 - DNA, 2069 bp, Pinus radiata
gtaatacagcatatttcaagaagctttctttcgaaaatggtgatctcaaaatatgcagcagcgatgtcgtgcttgctcatcgcagtagttgcattagaggttggggcagaaacgagacattacaaatttgacataaaattcaagaacgttactcgtttatgccacacaaagccgatagttacagcgaatggcaagttcccaggcccaacaatatatgcacgagaaggagacacagtcactgtgaaagtaaccaatcacgtgacatacaacgtgtccatacactggcacgggataaggcagttgcggactgggtgggctgatgggcctgcttatattacgcagtgccccattcaaacaggccaaacttatgtatataactttacaatcacagggcagcgaggcacacttttctggcacgctcacattctctggttacgtgcaacattgtatgggcccatcgtcattctacccccaaagggggtgccgtaccccttcccgaagcctgataaagaggttatattgattctaggtgaatggtggaattccgacaccgagaccgtcattaaccaagcgatgaattcaggattagcaccgaatagttcggattcccacacgataaatgggaaggcggggccactattctattgtcctactaaagatacttttgcgttatccgtggagccagacaagacatacctgctcagaatcatcaacgctgcgctcaatcaggaggtcttcttcgacgtggcaaatcatcatctgacagtggtggaggtcgacgcagtgtacacaaaacctttcgagacaaaggctatagtaattgctccaggacagaccaccaatgctttgctccacacagacaaaaaagctggaaggtatttcatggctgcccgagtattcatggacgcacccataaccgtagataacaagacagcaacggccatattgcaatacacaggaagctcaaactctctgaaccccgtattgcctctaattcctgcgctcaacgataccgcgttctcatctaattttagcaacgctctgaaaagtctaaattcaccgcaatatcctgctaaagttccccaatcaatagatcgcaatctcttctttactgttgggctagccctaaattcgtgcccaacttgcatcaacggctcgcgccctgctgcatctgtgaacaatataaccttcactatgcccaccgttgctcttcttcaatcacattacttcaacatcagtggcgtcttcactaccgatttcccagataatcctcctgcaacttttaactacactggcacaccgccaaagaatctgcaatcctcaaatggaaccagactgagccgcatacccttcaattccacagtgcagttggtgcttcaggacacaagcatgctgacagtggagaaccatccagtccatctacatggcttcaatttcttcattgttggaagagggtttgggaactatgatcctaagaaggaccctgccaaattcaatcttgtggatcctcctgagcgcaacactgtcggcgtgcccactggtggctggacggttatccggttcagagccgacaatccaggtgtctggttcatgcattgtcatctggaagtacacaccacctgggggctaaagatggcatttctggtagagaacggacacggtccagaacaatccattctgcctcccccaaaagacctgccccagtgctagtcaattcattctgaaattcttcatgaactttgagattcggtatactgttaataactttcgaattgttatgacacctcttaaataattactgtgttctcgacatcacgtacatactgattttccttgtagcagctacaccagtggatttctctggagattttgtgatgtcgttcaaaatgtttgtgtgagaatcgccctactccaaaaaatttgaataagtttggtctccggcggttggatttgtttaatagatcattgtattagatatgtaacattacatcaatttgtaaagcttgacgattattgtcgaactgttaatattacatgttacaagtaaatttcttcttttaaaaaaaaaa

SEQ ID NO: 49 - DNA, 2168 bp, Pinus radiata
ttttatatcagtagtatcaacggatacacccagggtgattgtgtgggagcttgaaaagaatatgggcgtgtcagtaatgcacattatgttgattgctatggttttcttgttttatttagccatggaagcggaggggaagacgaggcattacaagtttgatgtagaactgaagaatgtgagccgtttatgcaacactaaacccattgtgactgtgaatggagagtttccgggtccaacaatatacgcaagggaaggagataccgtcatagtgaaggtgaccaatcatgtcaaatataacgtttccatacactggcacggggtgaggcagctccgcacgggttgggctgatgggccagcttatataactcaatgccctattcaaacgggccaaagctacgcgtacaactttacaatcactggacaacgaggcacactgtggtggcacgctcatatactgtggttgagggcaacaattcacggagccattgttattttacctcctaaacataatccatatcccttccccaaaccccacaaagagattactgtgcttctaggagagtggtggaatgcagatgtggaagctgttatcaatgaagcgcttaaatcgggaggagcacccaacgtgtctgatgctcacaccattaatggaaagccaggaccactcttcaagtgccctactaaagacactttcgtggttccagtggagcatgggaagacttaccttcttcgaatcatcaacgctgctctcaatgatgagctcttttttgatgttgcaaaccatcacctgaaagtagtggaagtcgacgcagtgtacacaaagccattggagacgaactcaatagtaattgcgccgggacagaccacgaatgccttactctacgccaacaaaaaaagtggtaggtatttcatggctgctcgctcattcatggatgctccggttgccgttgacaataaaaccgccacagccattttgcagtacgtcaattccaattccagtacagatttcgttgtgatgcccagcattccttcgcagaatgatacctcctttgccaccaacttcagcaacaatctccggagcctcaattccgcccgatttcccgcaaaaatcccgcagactgtagatcgccatctctttttcacagtagggcttgccctcgactcgtgtcccacttgtaacaatggttcccgtgtatctgcatccatcaacaacgtaagtttcgttatgcccaagatttctcttctgcaagcccatttctttaatatcacgggtgtcttcaccactgattttcccgataggcctcccacgcctttcaattatacgggcactccaccaaaaaacccaatgacatcgaagggaaccagactcgctcggattcccttcaactccacggtgcagttggtacttcaaggcactagcgtgctgacagtggagaatcatccagtccaccttcacggcttcaatttcttcattgttggaagaggatttgggaactatgacccaaagaaggaccctgccgaattcaatctggtggatcctcctgagcgcaacactgtgggcgtgcccaccggtggctggacggctatccgattcagagccgacaatccaggtgtttggttcatgcactgccatctggaagtacacacaacatggggactgaagatggcgtttgttgttgagaatggagatggacccaaccaatccattttgcctcctccaaaggaccttcccaaatgctaatgattccaatggtggcgctgatcataacagccattgcgtcgttacatatttcactgacgtgatcgaaatcgacaattttagaggaaggactttcatgacggagaccaagcacagttccgtttgtatcgagagtcgaatatgctttcttaaaatgcccatttgttatggtcggggctttatctacgtaatcaagtcaaaaaatttcatcttataatattaaatgaaattaataaataattaaaatttgggaatagaaaatgaaattaataaataattaaaatttgggaatagaaaatggagttatttccacacagcaatgtaaaggattacatctccttatctcagggtaggatagactcccaatgacattagagcatttgttttaaaattttaaatgagtgccctatcgtttgcagcaaaaaaaaaa

SEQ ID NO: 50 - DNA, 2055 bp, Pinus radiata
acagctaaattcaaactagggtttcataggttataagctaagtagcgggaggaaaatgttgaactcaaagacattgctctgcctttgcccttgcccttgcccttccagggcagctgtgaagtacttgttaattgtcatcctgctggtcatcattcagtacctggatatagcatcaggaaagcattggcagacaaccaggcattacaaattcaatgtgaggcagagtaatgtgacacgtctttgcaacacaaaacctttgatcacagtgaatggacaatatccaggacctaccatttttgctcaggagggagaccaagtaattataaaactggtaaaccacgtcaaggacaacgtcactattcactggcatgggattcgacaactgagatctggatgggcagatggtcctggttatatcacccaatgtccacttcaaactggaatgagttacgtttataacttcaccatcacaagacagagaggaactctatggtggcatgcacacatttcttggttaagagctagtgtacatggtgccatcattatatatcctaagccacatgttccctacccatttcccaagccatacaaagaagtgcccattattctaggagaatggtggaatgcagatactgagaaggttattcagcaagccctccaatcagggggaggtccaaatgtgtcagatgcctacacaataaatggacttcctggaccactttacaattgctctaatgatacatttgttcttaatgtcaatcctgggaagacatatcttcttcgaatcatcaatgctgcactcaatgatgagctctttcttgccattgcaaatcacagcatgactgtggtggaagtagatgcagtttatgtgaagcctttccagacagacactcttgttataacacccggccaaaccaccaatgtgttattcactgctaatgctactgttaatgttggaggagttaaccagttttacatagcagctcgcccatttgctacaggtggtggaacatttgataactccactgttgcaggaattgtgagctacaacatttccaactctaatacctcttccaccattatgatgcctaaactcccagcccttaatgacacttcctttgcagccaattttagtgcaaaacttagaagtttggccacctcacaattccctgcactcattcctcaaacagttgacaagaaacttttctttacaattgggttgggactgaatccttgtccaaaggggatgggaaatgccacatgccaggcacccaatgggacaagattcactgcgtctgtcaacaatatttcttttgttctcccaaacactgctcttcttcagtctcactatttcaagcagatgaaaggagtttataagactaattttccagacaatcctccattcccattcaattacactggcactccacccaataatacacaagctgtgaatgggactagagtaaaagtccttccctttaacgcaactgttcaattgattcttcaagacaccagcatcttcagcacagacagccaccctgtccatctccatggtttcaatttctttgtggtgggccaaggtgttggaaactacaatgaatcaacagatgcaccaaaatttaacctcattgaccctgttgagagaaacactgtgggagttcccaaaggaggttgggctgctatcagattccgtgcagacaatccaggggtgtggttcatgcactgtcatttggaggttcacacatcgtgggggctgaagatggcgtgggtagtaaagaatggaaaagggccccttcaaactctcccacctcccccttccgacctccctccttgttgatcctcttcatttcatcactttcatttcattattgtttcttgcttttctttcagatgttgtcgacagagggtttttgttaggaagatttcacaataagcagccttttcctccaacgaggaagatggctatttatttagggaaagaaaaatgcttcacactggtaattcaacaaggggcaaccaattacagtgtggaactgtattgaatcactgtacata

SEQ ID NO: 51 - DNA, 2275 bp, Pinus radiata
ctttatctgtcacgaaaatttatttggacagaggccgcttgctctttaagaaagtttgtgatacctggagaagctgagtccagttcaaacagttttaattactaagcggaggaaatacaaatcggttttgttagcgaatagctctcaaagattggctatacaatggcagaattagggttgaatcgaccgcacgtcaacaaaatgcggccaatttcagcgaagctaatttttctgttggtggtgtgcctgaaccttttcgctgctacagccatgggaagcatacatcgatacacgtttgatattgaatccatgtccgtaacaaggctgtgccggacacacaacataattacagtgaatggacagtttcccggtccaacactccatgttcacagtggagacactcttatagtggaagtccgcaacaaggcccagtataacgccaccattcactggcatggaatacggcagttccgcacagggtgggctgatggaccggagtttgtaacccaatgccccattcgccctggtggaagttacatttacaaattcaaaatcactggtcaagaagggaccctctggtggcatgctcatagttcatggcttagagctacagtctatggagccttaattatctatcccaagaggggaactgcttatccctatactgtcccggataaacagtttcccatagttctgggacaatggtggaattcaaatcccattgatgttgtgaatgaagcgacactcacaggagctgcccccaacatttcagacgcttatactataaatggccagcctggagacctatacagagacctatacaattgttctacttcagatactactcgtattcgagtgaaggcaggagaaaccaatcttctacgcgttatcaatgctgcaatgaacaatgacctattcttcgcggtggcaaatcattcaatgaccgttgtagctgtggatgctttgtatacaaagcctgttcagaccaattttctgatgctcggccctgggcagactacagacgtacttgttactgctgatcagtctataggcagttattacatggctgcgcgcgcatattccagtgggcaaggagttgccttcgataacaccacaaccactgccattttggaatacgctggagttaactccacttcctcatctccacagatgcccgatttgccgttctttaacgacactaaatctatgacacagttcaacgcggctctgagaagcttggcctcgccccagcacccagtctctgtccctcacacggttgaagagaatctgctctacactgtgggaattgggttgttcaatggaacaagattgggagcaagtatgaacaacttttcttttgttctgccatcaacggtgtcaatgcttcaagcacactattttggcataaaaggcgtattcaccgagaacttcccggataaccctcctctgcaattcgattataccgcacagaatataagcacaagcctgtggtctcctgtaaaagacacgagagtgaaagtgctgaaatacaacacaacggtgcaagtggtacttcagggaacgaatatcgttgcgggtgaaagccacccgattcatctccatggctatgacttctacatcgtgggaacaggattcggtaattacaatgcaagaagagacccaaaacacttcaacctggttgatcccccaaagcgcaacactgtaaacgttccagtcaatggatgggcggctataagatttgtagccgacaaccctggtgtctggatgttccattgccatctggatgtacacgtaacgtggggtttggccatggtctttgtagttgagaatggaccagataatggatccagccttcagcggcctccgcgagatcttccacgctgctcagaaattgagcagcaacttatcttgcccaacgtcgacagcagcacaacaacgagttaattaccttattccagccacgttaaactatttgtttaggactttgcaaaggcattcgtactcaccatattcaattttatacttttcctttcccgtccaaataatgagtttgcaaagccattcgtcctcatagtgtttaatcattccggagaagataaattcttttccagattgactgctcttagtttttaatcattcaagagaagataaattcttttccttaggaattgaatgctccattttatattgtttaaaaaaaacagctattacattgtatttagcgatacctttgttatcattcatatttgactgctttactttgtcaaaaaaaaaa

SEQ ID NO: 52 - DNA, 2530 bp, Pinus radiata
atatgttgcagaaattttgatgcatatggcatttgtacggaactgtagttttctggccatggaaaacccatgatgtttgttggaccacactggtattttgttgtgtttgaggttctgccacctcttcccaaatggagatcagctgtctgcagactgagataggtagatggattacagctttctaaagtaagtcagcagaagaaagttgcaagttctagcgatgtttgtgatcttcctgcttgctcaactacttcatctatgccaatcacgttttccattacttttctcacaaggacagttactttcaataaattttataggcaaatataaaatcttgtctacctccttgtttcctacaatgaacagtactgatctctcaatcaaggccaatgtgtctcggtactaatttgaacagtacactagcagagatcagcattgttgtttgaacttgtctcagtgccaaagaaaaggcggtgcaaatggatagaatactccgccaatcctcattcaatgtgttgctgctggttcttagcttcagccttttacagtggattccatgtctgtgtcaacccacaaccagaacatatgatttcaaggtacagttgaagaatattaccaagctatgcaacaccaccaccattgctactgtgaatggaatgtttccaggaccaactatctatgcacaggaggatgacaccgtcatcgtgaaagtcacgaacctagtgtcctacaatatcacattgcactggcatggagtgaagcagaagttgagctgttgggcagatgggcctagattcatcactcagtgcccaattaaaacaggtcagaattacacatacaagttcactctaacgggccagagaggaacactatggtggcatgcgcacattgcatggttaagagcaactgtaaatggcgcgattgttatctacccaaagacaggagttccatacccattccagtttccgacagaggagcatgtccttattctaggagaatggtggggcgccaatgttgcaaatcttgaaaacgctgtcatggcgtctggaggaggtccccctctttctgatgcttacctcatcaatggtcatcctggaccaacctataactgttcagctcaagatgtgtggacaatgccagtggttaaaggaaaaacgtacttgatgcgggtgatcaacgctgctctcaatattgagcacttcttcagcgttgccaagcataaaataacagttgtggcaacagacgcagagtacacaaagccatacacggttgataacataatgatagcccccgggaatacatatgacatcctcctcagagcatatcgtgggcccaacaaggactattatataggaataagcccttatctgtctgccaatctaacagtcaatactggaaagagttttgccatcttaagctaccagagaaattcttcctcttctgctccaattatcaaacccagattccccaaaataaatgactccgctgctgtcttcacaggcatgagcctcatgaaaagcttgaattcccaagcatatccagcaaatgttccacagaaggtggacagaaatctattttttgccctagaactgaacctggaagcttgcaaaagaggacagacatgcaatgcccctaacaacacaagattccaagcttccatcaacaacgtcacattccaagttcctcaaacctccattttacaggcctactatgacaacatccagggggttttctctaccgatttcccagataaccctcctagcccatttaattatacaggaaatattatgtcgaatctgcagtctaactttggcacaagagtttcagtcttgaagtacaatcaatcagttcaactcgttctgcagggcactaatcttacctctgcagaaaatcatccagtccatctccatggtcacaatttcttcgttgtgggatatggaacaggaaactatcctggcccttccaacttcaatttagtggatccaccatcaaggaatattattggagtgcctcccaatggctgggttgctataagattcattgcagacaatccaggagtatggtatctgcactgtcatctggagattcatttgacatggggtctatcaatggcgttcttaaccttgaatggaaatggacctaatcaaacacttcctcctcccccaccagactaccctaaatgttaacatgattcgaattcaatcactggatcaattcagacattctacattattgattcgttaccacctatctcccatatatttaaattagattcatgtaataactctaacgagtttattcatgataactggttgatcctgaggcttccgtcccatattccccacaagttatcaattaataacccattgcagaagttgtacttcaatcattctataaatgatgccatcgagctcattgttgacaaaataaacttgtggaagttgtaattcgactattctgtaattgatgacatcgagcttattgttcacaaaataaacttgtgtaattctgttctctgttaaaaaaaaaa

SEQ ID NO: 53 - DNA, 1851 bp, Pinus radiata
gtctttctcagaaatttaggtctctttcatgaaaattcacttgcctgcagaagaaatggtgctatcaatggctgcatgcagaaacattgttgtgaaaacgatgctgattgctatgtttctgcttcctggcgctgtccagggtgaaacaaggcattataagtttaacatacaactgaagaatgtcactcgtatatgtcacacaaagcctatcgtgacagtaaatggagagtttcctgggccaactattgaagccagggaaggagatacgctgctaatcaaggtcactaatcatgtcaaatataacgtgtcaattcattggcatggggttaggcagctccgcacgggttgggctgatggacctgcatacatcactcaatgtcccattcaaactggccagacctacatttacaacttcacagtcacgggacaaagaggcacactgtggtggcacgctcatatactctggttgagagcaacactttatggagccattgttatattacccccaccaaatgtgccctacccctttgagcctaaaccccacaaagaaattactttggttctaggtgaatggtggaatgcagacgtagaagctgttatcaatgaggctctgcagacaggagcagcaccaaatatatccgatgctcatactatcaacgggaaacccggagaaatattcaagtgtccagtaaaagataccttcactcttccagtagagcacggaaaggtttacctccttcgaattgtgaatgctgcactcaatgatgaactgttcttcgaggtagcaaatcatcaggtgaaagttgtagaggtggatgcagtatatacgaagccctttgacaccaaagcaatagtgattgctccaggacaaaccacgaatgttttgctcgaggctaacaaaagatctggaagttatttcgtggctgctcggccattcatggatgcacctgtgacagtgaacaacaagaccgcaactgccattttgcactacatcggcaggaattctgaatcagatattcccgccgttaatcctctcatgccacgacttcctctcctcaacgacactgcgtttgcaacgagtttcacctccaagctcagaagcttgaattctgttcagtttcccgcaaaagtcccgcagacaatagatcgcaatctcttcttcgcagtggggcttgcgacggagtcttgtcagacctgtaacggtggcctccgtgcttccgcatcaatcaacaacataagcttcgtcatgcccagcatttctcttctggacgcccatatctttaacatcagcggtgtgttcactgccgattttccggatagaccccccacgcctttcaattacacgggcacaccaccaaaaaacctaattacatccaaaggcaccagactcagccgccttcccttcaactcaacagtgcagttggtgcttcaagacacaagcgtgctaacagtggagaatcatccaatccatctccatggtttcaatttcttcatagttggaagagggtttgggaactacgaccctaacacggatcctgccagcttcaatctcgtggatcctcctgagcgcaacactgtgggtgtgcctacaggcggttggactgtcattcgttttagagctgacaatccaggtgtttggtttatgcattgtcatctagaagtgcacacaacatggggattaaagatggcgtttctggtggaaaatggagatgggcctgatcaatccatattaccccctcccagtgattttcccaagtgctagtaaaaccaaattctaaattctaccaaaattgttttcacttagatttgtactcagaattttcgaatttgtattcattttcaaaaaaaaaa

SEQ ID NO: 54 - DNA, 1950 bp, Pinus radiata
ggttttgtgaaattataagaaaactgtacaactcttgatttggtgtgtctaattgtgctgtcggtggctggttgagcgaaagaaagaggatggatttgggattgcgacagtggctactttcggagagccgcgtagagttttatgttaaacttgccgctgctctttttctagctgtattactagcgtcatggggcaagggaaggaagcggaggatgcccccggggcctttcccgttacccattatcggcaatcttcacatgctgggagaccttccccaccgagcgctggaaaaactttctatgaagcacgggcctctcatgtctctccgcctcggctctgtcctcaccttagttgtctcctctccagaggtagccagggagttcctcaagacccacgatcagcttttcgcaagcaaaaatccgtcggccgccgctaagcttttatcatttaattatgcggacttcggcttttcttcttatagcccttactggaggcatttgcgtaagatctgcgctttggagttgctgagcggcaggcggttagatagcctccgctttattagagaagaggaagtctctgccatgattcgctctattattaattcagatggatctcgtcccttgaacattaaccaaaccttggcgtccgttgcaacggctataatctgcaggatggccttcggcagaaattattcggaccaagaattgaaagctttcaattcaatggtcagagaaagttttctgttactgggctcatttaatattggagattacataccttatttggactggatagatttgcaaggtttcaaccgccgaataaagaagctacatgagacgcaaaatcatttgttagagaaagtaatagaggaacatgttgcccggaatgagtccaacatcacacatgatcttgtggatgtcttacttgcagcctctgcagataaagatagcgagttccagatttcacgagatagtataaaaggagttatttttgatgtgttgcttggtgggtcagacactgcacctacggcgatagagtgggcaatgtcagaagcgctgagaaacccaccagtgatgaagaagcttcaggacgagctggagagtgtcgttggattgggtcgcatggtatgtgaatctgacttgcctaagctcgtttatttacaagctgcggtgaaagaaactcttcgactccatccatccgggcctttattggtgcgccatttatttggtaccgcgtcctgcaatgtattggggtatgaaatcccgcagaatactctcgttctcgtgaatgtttgggcgattgggaggaaccctaagtcatgggaggacgccgaagttttcaagccagagagattcatggaaaaagttgggtctgaagtagatgcaaatggagatcaaaactttgggtgccttctcttcggagcagggcggagaagatgcccaggacagcaattgggaacgcttcttgtagagtttgggttggcacagctgttgcactgcttcaactggaggcttcccttggatgacataaatggcgaaaatcaagaagtggatatgaatgaaatgtttaatggagtcacgctgcgcaaagctcgtgagctctcggctattccgacaccacgccttgaatgcattgctcacctgaaataggtcatcaggtttcgagtgaaacctgtggaaatagaagtcttttctggtagaaaacggtcccagatagtagctcagagccgtgggttgaaaagtccttctatgctattttgtattggggatcgaaataggtttttggacgtgtggtgtttggggttcagaaagcggttatgagctgtgtatccaatatccaagatagcgagttcgtttcttgtaaatataacgcgtagcatctaaatacacagtgtgtaaatatgtacacagtggactcgataaagcaatgattcttgttataaaaaaaaaa

SEQ ID NO: 55 - DNA, 1773 bp, Pinus radiata
gagtagacgcaaagcacaaaatgggttttgatggaaatttagtttcagatatcgtggggataacaggcggtggccttaatgcctactactcactaggcctattagctctgtttgggtcatgggttttattgctcagaatccgtccatggtctgcaaagctgctaccccctgggcctcctgcgttgccaataataggaaatcttcacatgttgggtaaacttcctcacagaaatctgagggacattgcgcagaaatacgggccgctcatgttcctgcgcttcggctccgtgcccaccgtggtggcctcttccccggagatggcggagcagttcttgaaaacccacgacctcaattttgcgggccggccttcgacgacggtggggaaaaacatgatctataattccacagatatcggtttttcgccctacggcccttactggaggacggtgcgtaaggtgtgcgtgctggagctgctgagtccccggcgcctcgagttgctcaaatttgtgagggaggaagaggtgtccgccctcttagagagcgtcaccaagtgctgcgcgtcgggtgaggcggcgaacgtgagcaagctggtgtccaccatgacaacggatatcatatgcaggatggccttcggcaagaagtactgcgaggaggacctggacagcagagggttcaaggacatgataaaggaggtcttctttctcagcggggccattaatattggggacttcattccatggttggagtggttggatctgcaaggcctgcgccgccgacagaagagctgccataacacctttgatgctttcttcgagatggttatagaggagcacatggagaagagcaagggcgatagtgctgataacaaggatttcgtggatgtcatgttgggactcatggataacaatgatatggagatcaagatcactcgagacaacatcaaggcagtcatctttgatatgctgggagcgggaacagacacttcctctgcgacgttagagtgggcgatgtctgaaatgctactaaatccttcaatgatgaggaaagtacaagaggagttggagagcgtggtgggactcgatcgcagggtggaggaaggggatcttccccgtctcccatacttaaaagcagtggtgaaggagacgctgaggcttcatccaccggggccattgcttatcccacatgagtccttcaatgattgcaccgtcggcggctattttatacccagaaaatctcgtcttatagtgaacgtgtgggccctcgcaagggaccctaaatcatgggaagatgctgacgtgttcaagccggagagatttgttggcagccccatcgacatcaaggggcaacatttccagatgcttccttttgggtcaggcaggagaggctgccccgggcaacccctggcgctaaccgttgtggaatataccttggccagtcttttgcattgttttgattggaagctgcccgctggaatgaaacccggggatttggatatgaccgaggaatttgggctgtccacaccacggtcagttcatctggttgcggtccccactctcaggttaaaagtatgaagatttggcgaccttcgagaatctggtagttgttaattatcaatatctaagtacagctaataaatgttatatttaatattccagtttatagaagcataaaatatatcgctcaagtttgagcgaaccagtgtttcattccatgaactggccaaaggagtcttacaattttctcaattccctaatattttgtcaaaaaaaaaaa

SEQ ID NO: 56 - DNA, 1900 bp, Pinus radiata
aaatgcagtagacgcaaagcacaaaatgggttttgatggaaatttagtttcagatatcgtggggataacaggcggtggccttaatgcctactactcactaggcctattagctctgtttgggtcatgggttttattgctcagaatccgtccacggtctgcaaagctgctaccccctgggcctcctgcgttgccaataattggaaatcttcacatgttgggtaaacttcctcacagaaatctgagggacattgcgcagaaatacgggccgctcatgttcctgcgcttcggctccgtgcccaccgtggtggcctcttccccggagatggcggagcagttcttgaaaacccacgacctcaattttgcgggccggccttcgacgacggtggggaaaaacatgatctataattccacagatatcggtttttcgccctacggcccttactggaggacggtgcgtaaggtgtgcgtgctggagctgctgagtccccggcgcctcgagttgctcaaatttgtgagggaggaagaggtgtccgccctcttagagagcgtcaccaagtgctgcgcgtcgggtgaggcggcgaacgtgagcaagctggtgtccaccatgacaacggatatcatatgcaggatggccttcggcaagaagtactgcgaggaggacctggacagcagagggttcaaggacatgataaaggaggtcttctttctcagcggggccattaatattggggacttcattccatggttggagtggttggatctgcaaggcctgcgccgccgacagaagagctgccataacacctttgatgctttcttcgagatggctatagaggagcacatggagaagagcaagggcgatagtgctgataacaaggatttcgtggatgtcatgttgggactcatggataacaatgatatggagatcaagatcactcgagacaacatcaaggcagtcatctttgatatgctgggagcgggaacagacacttcctctgcgacgttagagtgggcgatgtctgaaatgctactaaatccttcaatgatgaggaaagtacaagaggagttggagagcgtggtgggactcgatcgcagggtggaggaaggggatcttccccgtctcccatacttaaaagcagtggtgaaggagacgctgaggcttcatccaccggggccattgcttatcccacatgagtccttcaatgattgcaccgtcggcggctattttatacccagaaaatctcgtcttatagtgaacgtgtgggccctcgcaagggaccctaaatcatgggaagatgctgacgtgttcaagccggagagatttgttggcagccccatcgacatcaaggggcaacatttccagatgcttccttttgggtcaggcaggagaggctgccccgggcaacccctggcgctaaccgttgtggaatataccttggccagtcttttgcattgttttgactggaagctgcccgctggaatgaaacccggggatttggatatgaccgaggaatttgggctgtccacgccacggtcagttcatctggttgcggtccccactctcaggttaaaagtatgagatattcgaagatttggcgaccttcgagactctggttgtggttaatcatccatatctaagtacagctaataaatgttagtatttaatattttagtttatagaagcataaaatatattgcaagtttgatagttagtttctgtacaattaaagtgtccaaagagtttttcagggtgctgaatccacatatacagttaaaaaaccattttaactgcaacaaatcaagatttaacttcgattttctccgccggattctatcaccggaatttccaaaaagtcccattatagacaactcatttttcttcatcaaaaaaaaaaaaaaaaaa

SEQ ID NO: 57 - DNA, 2164 bp, Pinus radiata
gacccctcgagaattcataaaaaactaacgtggagtgcgagaaagtggaatacgaaatttggaagacagcgagaggtaggtgcttatccttgcaggcgtcatgacaaatcatacgcaggtgagatttcgtgactggctcgtgttggtcttggaagtcggcccagtcctccttcccctacctactccagacgtgacctccaaaactcccatgtatggattttcgcattatacatagccaatctacctcccccttcaacccaagccattgttctgcaggggaatgtctgttcctgaaatgggtccgtttggagttgtggtgagtggtattgtggccattgccatagtttacaagctggtgcaacggtggagattcaagttgccaccaggtcccagaccatggcctgtggtggggaatctgctacagatagaacctgtgagatttagatgcttctgggactggtccaagaaatatgggccaatcatgtctgtgtggtttggatccacactcaatgtagttgtgtccaatacagagctggctaaggaggttctcaaggagcacgatcaacagcttgccgacaggcccagatccagatcggctgagaaatttagcagaaatggccaagacttgatttgggctgactatggtcctcattatgtgaaggttaggaaggtctgtactctggagctcttctctcccaagagattggaggccctcaggcctatcagagaagacgaggttgcagccatggtagaatccatattcaatgactgtggcaaacaagaaggaatcggcaagcctttgatggtgaagaaatatctgtcaggtgtggcattcaacaatatcaccaggcttgcttttgggaaaaggtttctgaatgaagaagggaagatggatccacaaggtgtggagtttaaggaaattgttgcaacagggttgaagctgggggcttccctcaccatggccgagcacattccctatctccgctggatgtttccattagaagagggtgcgttcgccaagcatggtgcaaggagagacaatgtcaccaaagctatcatggaagagcatacacttgccaggcagacgagtggtgccaaacaacattttgtggatgcattgctcactctacaagaaaaatatgatcttagtgaggatactattattggcctcctctgggatatgatcacagcaggtatggatacaacagcaataactgtagaatgggccatggctgaacttgttcgcaatccccgaattcaacagaaagcacaggaagagatagaccaagtcgttggcagggacagagtgatgaacgagactgattttcctcatctaccatacctgcaatgcatcacaaaagaggctctccgcttgcatccacccactcctttgatgcttccacataaagcaacacagaatgtcaagataggtggctatgatatacccaaaggatccaatgtacatgtaaatgtgtgggccattgctcgggatccagctgtatggaaggacccagtgaccttcaggcctgagagatttcttgaggaagatgttgatattaagggccatgattacaggctactgccatttggtgcagggcgcaggatctgccctggtgcacaattgggtattaatttagttcagtctatgttgggacacctgcttcatcatttcgtatgggcacctcctgagggaatgaaggcagaagacatagatctcacagagaatccagggcttgttactttcatggccaagcctgtgcaggccattgctattcctcgattgcctgatcatctctacaagcgacagccactcaattgatcaattgatctgatagtaagtttgaattttgttttgatacaaaacgaaataacgtgcagtttctccttttccatagtcaacatgcagctttctttctctgaagcgcatgcagctttctttctctgaagcccaacttctagcaagcaataactgtatattttagaacaaatacctattcctcaaattgagtatttctctgtaggcgatgttacttgtgcaatttgcaagatatagtaaagtttactctagtgtattttactagtcctatgtaacatgcggaactgatagagtgcattcagaaagccttaatagatgttggtgcttgataggtttttaaaaaaaaaa

SEQ ID NO: 58 - DNA, 1836 bp, Pinus radiata
agaggcatttccttgtttaatatatcacctgtgtgaggaacctcttccacacgcatttttctgttgtatatgacttgtgggatgattcgatttcagcgcaaatagatgtactggtatctctcttttatctgaacggttgccggttaccttgtttgcatatacacggtcactatggatattggatgggtttcatggtattctgtgctgggaatcacttccgccattgtattcttggtgttagatttgtggaggaggaggacttatggcaggcttcctcccgggcctctgggatggccgattgtgggaaatctgttgcagttgggtaacaaccccaacgaatctctcttccatctcgctacaaaatatggtcctctaatgtctgtatctcttggaatgaaaaccacagtggtggtctcctctccggccatggcaaaggaagttctcaagacccatgaccagctccttgcggggcgaactgtcatacaatcagtcaagcctgcttcccacgacaaatactcatttgtctgggcccaatatggatctcactgccgtatgctcagacgaatatccaatacagagctcttcaatgtcaagaggctagggactctgcaagatttgagaagagatcaagtattgttaacgatccagcgaattctgcaggaaggtatagaggggaaaagtataaatatcgaagatgctatggtccacttttctgttaatctattaggcaacatggccttcggcaaggacatgttcgattcccactctccagccttcgaagagtttaaaaatagtatttctaatatgatgacgagtttaggagctcccaatttggcggactatttcccctttcttcagcggttggatcctcagggtgttggacataacacaaaaatctgtatggaaagggtattccgtattctggacaaattcatggaggaccgcctggtcaaaagaggcaaaaccatggacggtaacgatgacgcgaaggatctcttggatgttctgctggacatgagaagcaatgaatttactgtcatccatatcagaagctacttaactgacatatttggggcagggattgacaccactgcgaagacaatggagtgggcgatggcagaactcatacgcaatccggagaaaatgaaacgagcccaggccgagttggaccaggttgttggccgtaaccgaagggtggaggaaagtgacaccgagagtcttccttacctttgtgcagtcgtaaaagaagtgttccgactgcacccggtaggtcctctgcttctcccacacagagcagttaccgcttgtgaaattgggggatacctgatacccaaagacacccaagtaatcgtgaacgtatgggcaatcggaagggacccttccatctggaatgagccttcgaaatttgtgccggagagatttatggatagtaagatgagtagtgtggatttcaagggacaacacttcgagctgctaccgttcggatcaggtaggagaatgtgcgtggggcttccgttggcgaatcggataattcatctggtcttggcttctctcctccattcatttgactgggcacctcccaagggcatgactgcagagcatgtggacatgaccgagaagtttggggtggtcatgcagaaggcagtgcccttggaaacaatgcctacgccacgcctgccaccggatctctactgacgtgtcctgacagacgaatctctgtttgttccatgtgatatccaaagtcttccttgcaaggtttttcaggtcagtaaatccaattggcaaaagcaataataatcttttgagattcatgtcgacatcatggttgatatttgg

SEQ ID NO: 59 - DNA, 1851 bp, Pinus radiata
gtctcgtgatttctctgaagtctaaaccccattgtgtttttgggtttgctggagagcacttgagcgatggaggaaattagtggtttctggtactatgtcatgattttcatgacattatggttggttttaaaggtcattaatatgtcaagaaagggcgcaggcaagctgcctccagggcctcccggatggcccattgttgggaatcttctccagctcggggggaagcccaacgagtctatgtatcaccttgctgcaaaatacggtcctctgatgacccttcaactcggaatgagaaccacagttgtggcttcatctcctgccatggcgaaggaagtattgaagaatcatgaccagatcctttcgggacgcactgttgtagaagcggccaaatgcctctcctacagcgacacttctttggtatggaacaactgtgggcctcggtggcgtatgcttcgaaaattctgcaacatcgagctgtttagtgtgaagagactggaggccttgcagcatctcagaagagatcaggtcttttccaccattcgatccatttttgaggattctataaaggcgaagggggtgaatcttgggcacagtgcgtttcttgccagtctgaatctgttgggcaacttgattttttctcaaaatattttcggacgggactctcaggccgctgaagaattcaaagaaacggtcaccaaattgatggtaattgggggaaagccgaacctggctgactactttccttttctccgaattttggaccctcagggggtgagccgcgattgcagcaagaatattgccattgtatttgagctgctggatcgatccgtagaggttcgcctgcagagtagaagagagggcagaactgatgacagcagtggcaaggcaaaagactttctggacatcttacttgaatacaaaagcgagagcggagaaactttcaccaagaaagacattatcccctttctatatgacatgttcgtggcgggtagtgaaacgagcagtgccacaattgaatgggcaatggcagaggcaattcgaaatcctcgcataatgaagaaagctcaagcagaattggatgaagtaatcgggacaggtagaagagttgaagaaactgacattgatcgcctgccttatcttcatgcagttgtgaaagaaacgtttcgtttgcacccgccagcgcctctgctgatccctcacagagcagaaagcagttgtgaagtagcagggtacatgatacccaaggacactcagctgctggtaaatgcttgggccataggaagagacccaaccatctgggatgaacccacaaagttcaagcctgagagatttgtggagtctgagatggaatacagggggcaaaacttcgaactgattccgtttggagcaggaagaagaatttgccctgggcttcctctggctcataggatggttcacgtggtcacagcttctctcctccactcattcaactggtctctcccggatggcatcacaacagacaccatggacatgagcgagaggtttggaatcaccctgcagagagcttctccattaatcgcaatcccctcactgcgcttgccctctcatctctttaacgatcagcatcactagtcaaacttcattctctcaacccgtcctctatccaactatcatcatttccttgcatgtagatgtatgtatgtcagacctttcttgcatatcatcatttccttgcatggagatgtatgtatgtcagacctttctggcctatcatcctttccttgcatgtagatgtatgtatgtgagagctttcttgcataatataatataataggaaaataaaacagttagcttatgctcttaaaaaaaaaa

SEQ ID NO: 60 - DNA, 2075 bp, Pinus radiata
gaattgcagaagcattgaattctcttccagaagcattgcataatgataatgatggagatgacgagtgtggcaaatatagagaaggggcttctggtcattttcgctgtaattgttgggtccattttcatatcgaagctcaaatccaagaagttcaagctgccccccggcccgctggcggtgcccatcttcgggaactggctgcaggtaggggacgatctcaatcacaagaacctgggggacctggcaaagaagtatggcgagatctttctgctgaagatggggcagaggaatctggttgtggtgtcgtcgccggaggtggcgaaggaggtcctgcacacgcagggcgtggagttcgggtcgcggactcggaacgtggtgttggatatattcacggggaaggggcaggacatggtgttcacggtgtacggcgagcattggcggaagatgcggcggatcatgacggtgcccttctttaccaacaaggtcgtccagcagtacagattcgcgtgggaggacgagctcggccgcgcggtggacgatatcaagaaacgacccgaggcgtccaccacggggattgtaatcaggaggcgcctgcagctggtgatgtataacatcatgtacaggatgatgtttgacaggcgcttccagagcgaggacgacccgctcttccttcggctcaaggccctcaatggcgagaggagccgcctctcccagagcttcgactttaactatggtgacttcattcctgttctcagaccgttcctcagagggtacctgaaaatttgcaaggaggtcaaagaaaagaggctgtcgctcttcaaggattatttcattgatgagcgaaagaaattagccgcgagttccagaggctccaaagtcacaggcgagaagtgcggcatagatcacatcttcgaagctgaggagaagggcgaaatcaacgaagacaatgtcctctacatcgtcgagaacattaatgttgcagcaatcgagacgactttatggtccatggaatggggaattgcggaaatcgtgaacagccccgacattcagcagaagatccgcgccgagctggacgctgtgatcgggcgggccgtccccttgacggagccggacattaccaaattgccctacctccaagccgtggtcaaagaaaccatgcgtctccacatggcgattcccctgcttgtgcctcacatgaaccttgaccacgccaagctctgcgggtacgacatcccggccgagagcaaaatcctggtgaacgcctggtttctggccaacaatcccgagtggtgggataaacccgaggagtttatacccgagaggtttctgggagatcaggagaagatcgaagcaagcgggaacgatttcagattcctgccatttggcgttggaaggaggagctgccctggaattatcttggctctgccaatcgtggctctggcgcttggaaggctggttcagaactttgaacttctgcctcctccggggcaatccagggtggatgtaacggagaaaagaggtcaattcagcttgcaaattctcaaccactctgttgtcgtggccaaacccatagactgaatatataaaaatccttcctagtccggaggagtgctatttttttcctaattaggtttagattttaggttggggccagctgaaccataccaataaggaaaatagtttttcacaatcgtagtcaaataaagtgtggaaaatagtttttcacaattgtagttaaataaagtgtggatttccaaggtattggtgagttgtcagttgttttgtgtgtctaaaggttggatggaagaatgatatgccttactagtaagaaagtgttttgttgttccaaccaaatgaagtgtagattttgttttttgtgcttagatgttggatggaagaacaatccagtgcactaaggagaaaatctttctttaccattccaaccaaataaagtgtagattttgttttctgtgtggagatgttggatggaagaacaatccaccccccattaagaagatcattctttacccttccaatccaataaaatgtaaattttgttttgtgtaaaaaaaaaa

SEQ ID NO: 61 - DNA, 2021 bp, Pinus radiata
cgcacgaggcttcagcagctcggggctgtgagtgtttcttcaatttcaattgcagaggcattgaattctccgagtacacaataatggagatcatgactgtggcaagtctagaaaaggggcttctggccattttcgctgtaattgtcggtgccattttcatatcgaagctcaaatccaagaagctcaagctgccccccggcccgctggcggtgcccatcttcgggaactggctgcaggtgggggacgatctcaatcacaggaacctgggggacttggcgaagaagtatggcgagatctttctgctgaagatggggcagaggaatctggttgtggtgtcatcgccggagctcgccaaggaggttctgcacacgcagggggtggagttcgggtcgcggactcggaacgtggtattcgatatattcacggggaaggggcaggacatggtgttcacggtgtacggcgagcattggcggaagatgcggcggatcatgacggtgcccttctttaccaacaaggtcgtccagcagtacagattcgcgtgggaagacgagctcggccgcgcggtggatgatatcaagaaacgacccgatgcgtctaccacggggattgtgatcaggaggcgcctgcagctggtgatgtataacatcatgtacaggatgatgtttgacaggcgcttcgagagcgaggacgacccgctcttcctccgcctcaaggctctcaatggcgagaggagccgcctggcccagagcttcgattataactatggtgacttcattcctgttctcaggccattcctcagagggtacctgaagatctgcaaggaggtgaaagaaagcaggctgtcgcttttcaaggattatttcattgatgagaggaagaaattggccagtaccacaggctccaaggtcaccggcgataagtgcgctattgatcacatcttcgaagcacaggacaagggcgaaatcaacgaagacaatgtactctacatcgtggagaacattaatgttgcagcaatcgagacaactttatggtccatggaatggggactcgccgaaatcgtgaaccaccccgagattcagcagaagatccgcgccgagctggacgctgtaatcgggcggggcgtccccttgacggagccggacactaccaaattgccctacctccaagccgtggtcaaagaaaccctgcgtctccacatggcgattcccctgcttgtgcctcacatgaaccttcaccaggccaagctcggcggctacgacattccggccgagagcaaaatactggtgaatgcctggtttctggccaacaatcccgagtggtgggagaaacccgaggaatttattcccgagaggtttctgggagaagagaagattgaagccagcgggaacgatttcagattcctgccattcggcgttggaaggaggagctgccctggaattatcttggctctgccaatcctggctctggcgcttggaaggctggttcagaactttgagcttctgcctccgcctgggcaatccaaggtggatgtgacagagaaaggagggcaattcagcctgcacattctcaaccactccgttgttgtggccaaaccaatagcctgaagctcagatcctgaaaaaaaaagtatagaatttcttccaagtctggaggagctggaagcaataaacactttatatatacagttgcagccaaatgaagtgtggatttccattgtaattcatccccagatggtttgttttgttgtcagtagttttgaagtccgtcagattgtttgcccgaatatgcactgtatccaaaaatttgttatgaattttggaaaaaaatgtttgtgatcactcattgtaaaagtacaccaattgggcttttaatattatggtttttcagtgaagtctgtccttctgatcaggattcagaagcatgtggacagggggtttttggaaaaaattgtttgtgatcactcattgtaaaagtacaccaattgggcttttaatattatggcttttcagtgaaaaaaaaaa

SEQ ID NO: 62 - DNA, 1694 bp, Pinus radiata
cagctcggggctgtgagtgtttcttcaatttcaattgcagaggcattgaattctccgagtacacaataatggagatcatgactgtggcaagtctagaaaaggggcttctggccattttcgctgtaattgtcggtgccattttcatatcgaagctcaaatccaagaagctcaagctgccccccggcccgctggcggtgcccatcttcgggaactggctgcaggtgggggacgatctcaatcacaggaacctgggggacttggcgaagaagtatggcgagatctttctgctgaagatggggcagaggaatctggttgtggtgtcatcgccggagctcgccaaggaggttctgcacacgcagggggtggagttcgggtcgcggactcggaacgtggtattcgatatattcacggggaaggggcaggacatggtgttcacggtgtacggcgagcattggcggaagatgcggcggatcatgacggtgcccttctttaccaacaaggtcgtccagcagtacagattcgcgtgggaagacgagctcggccgcgcggtggatgatatcaagaaacgacccgaggcgtctaccacggggattgtgatcaggaggcgcctgcggctggtgatgtataacatcatgtacaggatgatgtttgacaggcgcttcgagagcgaggacgacccgctcttcctccgcctcaaggctctcaatggcgagaggagccgcctggcccagagcttcgattataactatggtgacttcattcctgttctcaggccattcctcagagggtacctgaagatctgcaaggaggtgaaagaaagcaggctgtcgcttttcaaggattatttcattgatgagaggaagaaattggccagtaccacaggctccaaggtcaccggcgataagtgcgctattgatcacatcttcgaagcacaggacaagggcgaaatcaacgaagacaatgtactctacatcgtggagaacattaatgttgcagcaatcgagacaactttatggtccatggaatggggactcgccgaaatcgtgaaccaccccgagattcagcagaagatccgcgccgagctggacgctgtaatcgggcggggcgtccccttgacggagccggacactaccaaattgccctacctccaagccgtggtcaaagaaaccctgcgtctccacatggcgattcccctgcttgtgcctcacatgaaccttcaccaggccaagctcggcggctacgacattccggccgagagcaaaatactggtgaatgcctggtttctggccaacaatcccgagtggtgggagaaacccgaggaatttattcccgagaggtttctgggagaagagaagattgaagccagcgggaacgatttcagattcctgccattcggcgttggaaggaggagctgccctggaattatcttggctctgccaatcctggctctggcgcttggaaggctggttcagaactttgagcttctgcctccgcctgggcaatccaaggtggatgtgacagagaaaggagggcaattcagcctgcacattctcaaccactccgttgttgtggccaaaccaatagcctgaagctcagatcctgaaaaaaaaaattgtttgtgatcactcattgtaaaagtacaccaattgggcttttaatattatggtttttcagtgaaaaaaaaaaaaaaaaaa

SEQ ID NO: 63 - DNA, 1818 bp, Pinus radiata
gttcgtgttatgtcttagtttccatttgcagcaagttagtgaacgcgggaggttggtaaaaatggggagtgaagtattggctcaaggatctgctctgttggagaaatccctgattgctctgttagtggttgtggtgggtgccgtgctggtgaacaagctgagaggcaggaagctgaagctcccgcccggtccattcgcattgcccatattcgggaactggttgcaggtcggggatgatttgaatcacagaaacctcagcgattttgccaagaaatatggcaaaatctttctgctcaagatgggccagaggaatcttgtggtagtttcatctcccgatctcgccaaggaggtcctgcacacccagggcgtcgagtttgggtctcgaacccggaacgtggtgttcgatatcttcacgggcaaggggcaggacatggtgttcaccgtctatggagatcactggagaaagatgcgcaggatcatgactgtgcctttctttacgaataaagttgtccagcactacagattcgcgtgggaagacgagatcagccgcgtggtcgcggatgtgaaatcccgcgccgagtcttccacctcgggcattgtcatccgtaggcgcctccagctcatgatgtataatattatgtataggatgatgttcgacaggagattcgaatccgaggacgacccgcttttcctcaagctcaaggccctcaacggagagcgaagtcgattggcccagagctttgagtacaattatggggatttcattcccattcttaggcccttcctcagaggttatctcagaatctgcaatgagattaaagagaaacggctctctcttttcaaggactacttcgtggaagagcgcaagaagctcaacagtaccaagactagtaccaacaccggggagctcaagtgtgcaatggaccatattttagatgctcaggacaagggagagatcaatgaggataatgttttgtacatcgttgagaacatcaacgttgcagcaattgagacaacgctgtggtcgatggaatggggaatagcggagctggtgaaccaccaggacattcagagcaaggtgcgcgcagagctggatgctgttcttggaccaggcgtgcagataacggaaccagacacgacaaggttgccctaccttcaggcggtagtgaaggaaacccttcgtctccgcatggcgatcccgttgctcgtcccccacatgaatctccacgacgccaagctcgggggctacgatattccggcagagagcaagatcctggtgaacgcctggtggttggccaacaaccccgccaactggaagaaccccgaggagttccgccccgagcggttcttcgaggaggagaagcacaccgaagccaatggcaacgacttcaaattcctgcccttcggtgtggggaggaggagctgcccgggaatcattctggcgctgcctctcctcgcactctccatcggaagacttgttcagaacttccaccttctgccgccggccgggcagagcaaagtggatgtcactgagaagggcgggcaattcagccttcacattctcaaccattctctcatcgtcgccaagcccatagcttctgcttaatcccaacttgtcagtgactggtatataaatctgcgcacctgaacaaaaaacactccatctatcatgactgtgtgtgcgtgtccactgtcgagtctactaagagctcatagcacttcgaaagtttgctaggatttcaataacagacaccgtcaattatgtcatgtttcaataaaagtttgcataaattaaatgatatttcaataaaaaaaaaa

SEQ ID NO: 64 - DNA, 1882 bp, Pinus radiata
ggtcaattcagcatgatggatataacaatgtctgcttgtgtgttggcttgctgtggattgttgttttttctggtgaaagttgccaagatcctttggtggaagcctctgcagatccagaaacattttgaatctcaagggatcagtggccctccttgcaggcttttatatggtaacatgcttgatatgcttaagatgagagaacaggcaatttccaggccaatggagttatcacatgatattattccccgggctctttcgttttatagccgttggactgagacctatggtaacacatttatccactggttcggctcgactgctaggctgaacattacagaccccgacctgatatgggaagtcttgtgcaacaaatctggtctctacaaaaaaagcgttcagatgaaacaactgaatggagaaggccttcttagtctggaaggagagatgtgggctcagcacagaagaatcattaatccagcattccatgttgagcatttgaagggcatggttccaatggttattggaagcacatcggctatgctggacaaatggaaagagagaattgaatcgggtgagaatgagatagaggtctgcaaagagttccagaatctaacagaagatatattggcacacactgtgtttggaagcagctattctgaaggaaaacgtgtcttcgccttgcaagctgagcagacaatgttaataactgaggttcccaggagtttgttgcgtgctctgataagcaggtttctgcctaccaaaaagaatcgatacatgagaaaactagacagagaaatccgggggtccctgaggcagctgattcaaagcaagaagcaaacttggagcttgggcaaatccagcagttatggtggtgacctcatcagtgtgatgacatccagcagcagagatcagcagcagcaaggagtggtgctgcagaagggcatgatgagcattgaagaaattgtggaggaatgcaagacattcttctttgcaggccatgatacaacattatgcctcttggcatgggccatgatactacttgcaatgcacccccaatggcaggaccgagcacgcaaagaaattctcagcatatgtagacaccaagctcccaaaccagaaaacctgaatcaactcaagataatgaccatgattctgaacgagtcccttaggctttatccaccagtagtggcgttgatcaggcaggcagagcaagacatgaagcttggaaacttctcagtccctgcgggcacccaactcttgtttccaatcattgccctccatcatgacccgtctctgtggggagataatgccaaagaatttgaccctgaaaggttctgcgatggagtatccaaggctgccaagcatcccatggccttcatgccatttgggatgggacccaggatttgtgttggacagaatttcgcactgctccagtccaagttgatacttgccatgatattgcagcgtttctccatctccctctctcctacgtatacacatgcgcccatccctgttgtgtttcttcagccccagttcggagcgcaaatcgttatgactccactttcacaggaatgatcagaagcaacaaaactcaagccattgtatggctccatggcgattctgatgagagcttggggtagcatgttgcaaaatgtaaagtttgaagttgttgaataggagcttggcttcgcctgatgtaaagtgaaatgtctgatgttgttgaaggggagcttggcgttggttgttgtaaaatgtaaggtttgatgttgctttaagtaaaagagatgtattgtcctttggtttataattaatgtaaaaagctactatgcttcagtgttttcttaatgtaaggccaacattttttttccaaaaaaaaaaaaaa

SEQ ID NO: 65 - DNA, 1866 bp, Pinus radiata
gcatcatatggtttcaggagccattcgtcattctcctcttttctaagaccttcctagtttatatataccctcctccattgtgtggcaatccacagtctgagcatgtcagagcaactcattggtgcagcaatggagaagctagacctacagagaggccttctggctctcttcgctctaatagtggctgctatttttgtgtcgaagctgaaatctaagaagctgaaacttcctccgggtccgcgggcggtgcccatatttgggaactggctgcaggtgggagacgatctaaatcaaataaatctgaccgacttagcaaagaagtatggcgacatctttctgctaaagatggggcagaggaatcttctggtggttgcgtcgccggagctggcaaaggaggtgctgcagacgcagggggttgagttcggatcccgcccgaggaacgtggtgtacgatatattcacggggagtgggcaggacatgattttcacttattacggacaccactggcggaagatgcggaggatcatgacggcgcccttctttacccacaatgttgtccagaagtacagatctgcgtgggaagaggagatcgggcgggcgatggaggatatcagggctcggcccgaggcgtcgagtgaggggattgtgatcaggggacgcatgcagctaatggtgtataatattatgtacaggatgttgtttgacaggaggtttgagagcgaggaggatcccctctttcttcgcctcaaaactctcaacgcccagaggagccgcatgggccagagcttcgaatataactatggcgattttattcccatcctcagtcccttgctcagaggatatatgaaaatctgcaagcaggtcaaggaaaagaggcaagcgctgttcacggaatcttttatcaaagagcgaaggcaattgggaattaccaagggcgaccggaagtgtgggatggactacatatttgaggcgcaggagaaaggcgaaataaacgaagaaaacgtgctatatctgattgacaacatgaatactgcaggaatggagacgattgtgtggacaatggaatgggttatcgcagaactggtgaaccatcccgagattcagcagaagatccgagacgaactggatgccgtcgtggggccgggcatcccaatgactgagtctgacattgtgaaactgccatacctgcaagccgtcatgaaggaatctctgcgtttacacattactcttcccttcgtccctcggttgaacgttccccagacgaagctcggcgggtacgatatcccggcggggaccaaagtgctcgtcaatatctggtggctcgccaacaatcccgagctgtgggacaacccccaagatttcattcctgagaggtttcttcaggagggtgagaagattgaattccatggaaatgatttcaggttcctcccattcggcgcagggagaagaagttgccctggaatccacatggctcttgcaaatgtggcgctgaccgttggaaggctgcttcagaacttcgagcttctgcctccgccggggaaatcgaaggtggatgtaagtgacaaagggggtcaattcagcttgccaattctcaaccacacactgcttgtagccaaacccagactcccagcctcaagctgaacgtccaacagctgcacccaataaaagcttacgttgcatttttcgttgtgctgacttctgtaagaccaacgtagtgcttgaattttaggttttaattggttgtactatagcttttctcctcggcatcgaggaaatcatggtgttaaacaacgtggctctcaaccttgttatgcatatttcaaataaaaaatgtggcaaacataattttcttaaaaaaaaaaaaaa

SEQ ID NO: 66 - DNA, 1419 bp, Pinus radiata
ggtaaagtcgtcctttggcagtctagtttcctctgctctgccacgatccaagtcagctctgtcgtattatttgtattgagattccaatttggtgacttcattgtagaaaaattcatcggacgaaggattgggaacaatataatgaatctagccacacactctggctttagtaacaatggattgtaagggcaacaccagcacagaggataattcatcggtagaaaaaatggaaggtgatgaatggcaggggagactggccatgatggagctggccaacatgctgagcgttcccatggctctcaacgcagtagctgaactaaacgtggcagacatcatttggcagaatggtgccaacaccccgctttctgcatcacagattttatcacagttgcaaactcaatctccagattcttgttcttctgctcataatctgcagagaataatgcgaatgatggcgagttacaacgtatttaaagagtctgttacagaggattccaatggagtccgtgagagactgtacagcctgactgatgtgggcaagactctggtgaaagacgagacgggattgtcctatgggtcctatgtgttacagcaccatcagaaagctttgatgggggcatggcctctgctccattcagcagtgctggatccatcagaggagccattcagaaaggccaatgggaaacctgcctacgaattctatggggacgacgaggattccaacgagctgatgaggactgccatggccagcctttcgatgccctttatgaggactgttttgaagtattaccagggcttcaaaggggtccgcacgcttgtggatgtaggcggaagctctggactctgccttcacatgatcatacagaagcatgggaatatcagaggaatcaacttcgatttgccctatgttgttgcaggggctccagcatatgatggtatagaacatgtgggtggtgatatgtttgaattcattccatctggagatgctatattcatgaagtggatcttatcgggatggggcgatgaaaaatgcatccaaattctgaggaactgttataaggcactaccagatggaggcaaagttattgcttgtgagccagttttgcccaaatacacagatgacagtcagaggacacgaactctccttgaaggggatatttttattatgacaatctacagttctggaggcaaggaacgcactgaagaagagtttcgcaaattgtgtagcgatgcaggcttctccaaagtcgagacccgtgatttggatcctttctacagtcttctagaaattcagaaatagctaatttggagatcaatcagcatatcctcaatttgattatattttattttgacatttatataattattattattacttcaaaatatttcttccattttgtgccaaaacactgtgaagtt

SEQ ID NO: 67 - DNA, 1297 bp, Pinus radiata
ggggatttccaacaatctcaggtattagcgattggtgcgcgatggattcgaacatgaacggcctggcgaagagcaacgggtgcgaaatcagtagggatggattttttgagagcgaggaagaggaattgcaggggcaggcagaggcttggaagtgtaccttcgcgtttgcggagtcgttggcggtgaagtgcgtggttttgctgggaattcccgacatgatcgctcgcgaaggtccccgcgccactctttcccttggcgaaatcgtggccaagctgcccactgaatctcccgatgccgcctgcctcttcagaattatgcgcttcctcgtggctaagggcatcttccgcgcctccaaaagcgcgcgggagggcggtgccttcgagacgagatatggcctcacgcccgcgtccaagtggctggtgaaagggcgggagctttcgatggcgcccatgctgttgatgcagaacgacgagacaacgttagcgccgtggcaccatttcaacgagtgcgtgctcgaggggggcgttgccttccaaaaggccaacggtgcagagatctggtcttatgcctccgatcatcctgacttcaacaatctcttcaacaacgccatggcctgcaacgccagaattgtgatgaaggctattctgtcgaaataccaaggcttccactccctcaattccttggtggacgttgggggtgggactggaaccgccgtggcagagattgttagagcttaccctttcattagaggcatcaactacgacctccctcatgtcgtggccactgcttcgtctctgtcaggtgtgcagcacgtggggggagacatgttcgaaacagtgcccactggcgatgccatattcatgaagtggatcatgcatgactggaacgatgaggactgtatcaagatactcaagaattgcaggaaagcgatccctgatacagggaaggtgatcatagtagacgtcgtgctggacgccgatcaaggagataatactgataaaaagagaaagaaggccgtggatccaattgttggcacagtatttgatctggtaatggtggcgcatagttccggcgggaaagagagatcagagaaagaatggaagagaatcttattggaaggcgggtttagtcgttacaacataatcgaaattccagcgttgcagtctgtgattgaggcgttccctcgttgagctgtatgcatattctgaatacatattttgaataaaatacttatcattgatgataaaatcaatgagagataaaatatgaatatgacagatttgtcggaaaaaaaaaa

SEQ ID NO: 68 - DNA, 1413 bp, Pinus radiata
cttcatcccattccatactcattcctttccttcatcatctctgctcacatggcagcagatcccatggactccattgatgacgttttggctcttgccaccgtccaacacatcaattcatcacgggatcccgcagcaacgcaccagctccagctgtatgagatgatactctctgcagtcaagccattggctttgaaagcagccgtgttgctcaacattcctgacatcattgccacacgaggcaatggaggtcccctttccgttgagcagattgcttttcacattgctgctgctaattcctcatctactagtaattcccatgtggatgtgggatacctccacagaattctgaggttccttgcttcctatggcgtttttactgaagaggaagaagcaaatcaggcagacggtgcagacctgaagaaaagaaagtatggcttgactggcatttcgaagctgctagcgcagggtgaaactcagcaatcttgcgggcatttcctgcacctgatagcaaacaacgtctacctggacgcttttcaacatttgcacgattctgtcttggagggctgctacacgtttaacaaagcttatggtatgagtccctgggaatatctgggccgcgatccccaagctaaccagattttcaacaacgccatggccgctaatagcagcactgtcatggcttccgtggcgaagatgtatgaagatgggtttaagagtatggccacgctggtagacgttggaggaggcataggcacttctttgttcataattgtgaaggaacattcacacattcgtggcatcaatctcgatctgcctcatgtcatcgccactgcgcctctcataactggggtggagcatatggagggaaataagttcgagcacataccgtctgccgatgcagtcatgatgaagtggatcctccatgactgggcggacgaggagtgtgtgaaattgctgagaagaagctacgacgcaacgccagcgaagggaaaggtgttaattgtggaagcagttgttgagggagacaaagaaggtgaaagcatgtcgaggcgattgggattgttatatgatatatcgatgatggtttatacaactggtgggaaggagagaacagaggaagaattcaaagggctgttccagcgcgcaggcttcaagagccacaccatcatcaagttgcctttccttcagtcgctcatagtgctgtccaaagcctaataagctattgcgcttccgattatcgttacaataacgttggttttgctggggttgttatcatgcagtatatgacctatgttttatgttatctggcagtataagatttctgaagacatggttgaaattattgtgagattttaaagatatttatccatcataaaaataatggaatatgataatatttttacaaaaaaaaaa

SEQ ID NO: 69 - DNA, 1403 bp, Pinus radiata
gctctgctcacatggcagcagatcccatggactccattgatgacgttttggctcttgccaccgtccaacacatcaattcatcacgggatcccgcagcaacgcaccagctccagctgtatgagatgatactctctgcagtcaagccattggctttgaaagcagccgtgttgctcaacattcctgacatcattgccacacgaggcaacggaggtcccctttccgttgagcagattgcttttcacattgctgctgctaattcctcatctactagtaattcccatgtggatgtgggatacctccacagaattctgaggttccttgcttcctatggcgtttttactgaagaggaagaagcaaatcaggcagacggtgcagacctgaagaaaagaaagtatggcttgactggcatttcgaagctgctagcgcagggtgaaactcagcaatcttgcgggcatttcctgcacctgatagcaaacaacgtctacctggacgcttttcaacatttgcacgattctgtcttggagggctgctacacgtttaacaaagcttatggtatgagtccctgggaatatctgggccgcgatccccaagctaaccagattttcaacaacgccatggccgctaatagcagcactgtcatggcttccgtggcgaagatgtatgaagatgggtttaagagtatggccacgctggtagacgttggaggatgcataggcacttccttgttcataattgtgaaggaacattcacacattcgtggcatcaatctcgatctgcctcatgtcatcgccactgcgcctctcataactggggtggagcatatggagggaaatatgttcgagcacataccgtctgccgatgcagtcatgatgaagtggatcctccatgactgggcggacgaggagtgtgtgaaattgctgagaagaagctacgacgcaacgccagcgaagggaaaggtgttaattgtggaagcagttgttgagggagacaaagaaggtgaaagcatgtcgaggcgattgggattgttatatgatatatcgatgatggtttatacaactggtgggaaggagagaacagaggaagaattcaaagggctgttccagcgcgcaggcttcaagagccacaccatcatcaagttgcctttccttcaatccctcattgtgctgtccaaatcctaataatttcggattatagttattgttaatgttgcttttgctgagcccaggttaggcatctttactggccaggactttggtcccaaggtttcagattcaagtctttgctgaacaatataataaatatataggttctagtattcaaatctttcctcagtgaacagtgtagtaaatattgtaatattcgctcagtctaataaatatagtaatatttgtataaaaaaaaaa

SEQ ID NO: 70 - DNA, 1595 bp, Pinus radiata
cccctttcaatacccgttcctttattggtctatgctcaccctggtacctccaatggactcgattcatcatgttttggctcctgcaaccgggcaacacatcgactcatcacgggaatcggcagcaacgcaggagctccagctgtatgagatgatattctctgctgtgaagccattggctttgaaagcagctgtgttgctcaacattcctgacatcatcgccacacgaggcaacggaggtccggtttctgccgagcagattgcctttcatattgctgctgctaattcctcatcaactggcaattcccacttggatgtgggatacctctacagaattctgaggttccttgcttcctatggagttttcgctgaacaagaagaggccgatcaggcagacgatgcagacaccaagaaaataaagttcggcttgacgggcatttcaaagctgctggtgcatgcaggaaatgagcaatcatgtgggcctttcctgctcctgatagcaagcaacgtctacctggaagcctttcaacatttgcacgaatctgtcttggagggctgctacacatttaacaaagctcatggtatggatccctgggaatacctgggcaacaatcccgaatccaacaagattttcaacgaggccatggccactaacactagatccgtcatggcttccgtggcgaagatgtatgaagatgggtttatgagtatggcaacgctggtagacgttggaggaggtatgggctctgccttgtccatcattgtgaaggaacatccacacattcgtggcattaatctcgatctgcctcatgtcattgccactgcgcctcccataactggggtggagcatatggagggaaatatgttcgagcacataccttctgccgatgcagtcatgatgaagtggatcctccatgactgggcagacgaggagtgtgtgaaattgctaagaagaagctacgacgcaacgccagcgaagggaaaggtgttaattgtggaagcagttgttgagggagacaaagaaggtgaaagcatgtcgaggcgattgggattgttatatgatatattgatgatggtttacacaactggtgggaaggagagaacagaggaagaattcaaagggctgttccagcgcgcagggttcaagagccacaccatcatcaagttgcctttccttcagtcgctcatagtgctgtccaaagcctaataagctgttgcgcttccgattatcgttataataacgttggttttgctggggtcgttatcatgcagtatatgacctatgttttatgtggtatgtcaatagtttgaatttttaaggagctaaaggatttagagtgctattatcgttacaattaatgttggttttgccttgcagtttaagatctatgtttttatgtggtaggtcaatagtttgaatttttcacgagcgaaaggatttatagtgcgagtaattgggatggcttccacgatactcttaactcagagatttataagattttttaagggtagacatggttgaaattattgtgaaattttaaagatatttgtccatcataaaaataattgaatataataatatatttataaaaaaaaaa

SEQ ID NO: 71 - DNA, 1443 bp, Pinus radiata
cccattccatgcgcagtcccctttcaatacccattcctttattggtctatgctcaccctcgcacctccaatggactcgattcatcatgttttggttcctgtaaccgggcaacacatcgactcatcaccggaatccgcagcaacgcaggagctccagctgtatgagatgatattctctgctgtgaagccattggctttgaaagcagccgtgttgctcaacattcctgacatcatcgccacacgaggcaaggaaggtcccctttctgccgagcagattgcctttcacatcgctgctgctaattcctcatcaactagcaattcccacgtggatgtgggatacctctacagaattctaaggttccttgcttcctatggcgttttctctgaacaagaagaggccgatcaggcagacgatgcagacaccaagaaaataaagttcggcttgacaggcatttcgaagctgctggtgcagggaggaaatcagcaatcatgtgggccgttcctgctgctgatagcaaacaacgtctacctggaagcctttcaacatttgcacgaatctgtcttggagggctgctacacatttaacaaagctcatggtacgagtccctgggaatatctgggccgcaatccccaagctaatcagattttcaacgagggcgtggccactaacactagatctgtcatggcttccgtggcgaagatgtatgaagatgggtttaagagtatggcgacgctggtagacgttggaggaggtatgggctctgccttgtccatcattgtgaaggaacattcacacattcgtgggattaatctcgatcagcctcatgtcattgccactgcgcctcccataactggggtggagcatatggagggaaatatgttcgagcacataccttctgccgatgcagtcatgatgaagtggattatccatgactggggggacgaggagtgtgtgaaattgctgagaagaagctacgaggcaacgccagcgaagggaaaggtgctaattgtggaagccattgttggtggagacaaagaaggtgaaagcatgtcgaggcgattgggattgtcatatgatatgttgttgatggtttatacaactggtgggaaggagagaacagaggaagaattcaaacggctgttccagcttgcaggcttcaagagctacaccatcatcaagttgcctttccttcagtcgctcatagtgctgtccaaagcctaataagctgtcgcgcttccgattatcgttacgataacgttggttttgctggggtcaatagttttaatttttatatctacgttttaaatctatgttttatgtgccacgtcaatagttttaatttttatatctatttatgttagtagatataatttttaaactgtttatgttttctcccatccaataatatttttcccgaaaaaaaaaacaagaaaaaaaaaaaaa

SEQ ID NO: 72 - DNA, 1623 bp, Pinus radiata
gtggtttttgaggagtgggtgggaagaagttttccgatctccaccccctgtacagttgataaaagccccattcccccaaatcttttcattcttgcaattttctgcttctcctctcagaatttcagccataaacttagagattcgaaatgggatcgggttttgaaaaatcagagatgaagtcgaagatagtaaatgaagatgaatggcttctgggcatggagctcggaaatttctcatgccttcccatggcgatgaaggcggccgtcgaactcgatgtcctccaaatcatagcaaatgccggcaatggcgtccagctctcgcccacacaaatcgttggccatattccgaccacgaaccctgacgccgccattactcttgatcggatcctcagagtgctggccagccattcggttctgagctgctctgtgaccacgaacgagaacgggaaggccgagaggttctatggtctcactcctctgtgtaaatatcttgtcaataatcaggatggagtctctctggctccactggtgttgatgaatcaagataaggtgttaatggagtcctggttttatctgaaggacgctgtgcttgaaggctcccagccattcaccaaagcccatggaatgaatgcgttcgagtacccggccatcgatcagagattcaacaagattttcaacagggctatgtctgagaattctaccatgttgatgaacaagattttggatacttacgagggttttaaggaggttcaggagttggtggatgtgggaggaggtattgggtcgactctcaatctcatagtgtctaggtatccccacatttcaggaatcaacttcgacttgtcccatgtgctggccgatgctcctcactacccagctgtgaaacatgtgggtggagacatgtttgatagtgtaccaagtggccaagctatttttatgaagtggattctgcatgattggagcgatgatcattgcaggaagcttttgaagaattgtcacaaggcgttgccagagaaggggaaggtgattgcggtggacaccattctcccagtggctgcagagacatctccttatgctcgtcagggatttcatacagatttactgatgttggcatacaacccagggggcaaggaacgcacagagcaagaatttcaagatttagctaaggagacgggatttgcaggtggtgttgaacctgtatgttgtgtcaatggaatgtgggtaatggaattccacaagtaactgtgagtggatgtcagctggattatcttcattgcctggtaaagcgatgatttcgttaagatgtcataccaaccatagttaagtccgactacgattatggtttaccaggttgagtaaagtggggcgggcggatcgggattgttgtttggttttctaaatgcaaaatagtttaaagcatgtacatataattggtggggacatgggcacatgtgaattattgatatcggtatcaaaatttgaacaacttcatagattgctcgttatcctttgaattattgatatagatatcaaaatttgaacaacttcatagatggttggttatcctttgaatctttggattattgatattaatatcaaaggttgaataagttcaaaaaaaaaa

SEQ ID NO: 73 - DNA, 1252 bp, Pinus radiata
tgagttaaagagttgtatgcacatccgagctgtgaacaaggaagggtttcttgttcagctccggatatgaatatgccatctgtgaaggacgaagaggcgcttcgggcttcggccctaagtctggcattttccttagagaacccttttctcctaaaaggtgccattcgtcttaaaatccctgacatcatctcgaaagccggccccgatgtttctctctccgtccaccagatcgccgcccaactcccctctgaagaccccgacatgggcgccctttcccgcattcttacttacctttccactatgggaatcttgcaggcaatcgtgccaccggagggagttaatgcccccatgaacataaaatacggccttaccaatctcaccaaaacccacttcacctccgaggatattagttcgcgaagcctagttcccttcgttcttttgcagacacacccactttacgttaccgcctgggaccatattgacgaacgtgtgcttcatggcggcgataatttcaagaattctagtggcaatggaaaagacttctggaatttcgcagccggcgatccggagttgaatgtcatcttcaacgcaggcatggtctccgtaacaaaggcctctatcacagatgtcttagctgtttatgatggcttcaaagacatcaacacgctggtggacgtgggcggagggcgcggggaagcgttgagtctcataattgaagcgcatcctcatattcgcgctatcaactttgatcttcctcacgttatcgcaactgcaccaactctccctggcgtacagcacatgaccggaaacctgtttgagagcgcaccctctgcagatgccatttttatgaagaattttctgcatagttggaacgacgaagactgcatcaagctactgaagaactgccaccaggctcttccggacaaaggaaagctaatattatctgaggctatcttggatttaacagaaggttctgacatgataggatctgccaatgttttagattctcttatgttgaattgtttaccgggaggtggtgaaaggacccgaaaacaatggaatgatctactccaagcagccggtttttctatttctaaaatcgtggggaggaacggcactttaactaaagttattgaagcaatcaagtcctaaatgtttaggtatattcctactgtttctttatcgcagaaaattaatgtgtttctaaaccgaaatatataaagcaagttcatatattgcattaaaaaaaaaa

SEQ ID NO: 74 - DNA, 1762 bp, Pinus radiata
aagacctgctcctaaaaagagactatgtacatggaagacctgctccaaaagtgatttcttccattaattttttttatgaaggaacaaatggattttagccatacgccctccccttcacctttataatcccggcaacacccagtcactgcgcagccatgggtgagtcttccccggcaacacactgcgcaacaatgggtgagtcttccccggcaacacactgcgcaacaatgggtgagtcttccccggcaacacactgcgcaacaatgggtgagtcttcctctcttttttcagcaacttccgctgctgcttctgctccagatgccgcgctccaaatagatacttcttcctcgcctcgactccaactctacgacatgatcttctctctggtgaagcccttggcgttgaaggctgccgttaacctcaacattcccgacattatcgccacccacggtggaggtgaaggtagctctctctctgtggaggatatcgcctcccacattgcagcatccgcgccctgcaacatgaatatgaaggcacctcacttggaatacctgtttcgccttctcagatatttggcttcctacaatgtcttcactgagacctcacacgctgggggagctgcagagtttaagcgatacagatatggcctcactgccctttccgagctgctaacggtgcagaatgaatattcgtgtgtgcctctggtgttctcagcgaccagtaaggtcccctgggaaggattgcagcgtctgcacgaaactgtgatggaaggctgccccgccttcaccaaagcatttggcatgaacgcatgggattatttcaggacctatcctcaagaaaatgagatttttaatagggctctcgccactgacactcgtgcggttatggcttccgttgtgaaggtttatgatgatgggtttaagaatataaatacggtggtggacgttgcaggaggaacgggatcggccatatccatgattgtggaggcacacccccacattcgtggcatcaatttggatctcccacatgtaatagacacggcccctgctttacctggagtggaacacgtgaggggaaatatgttcgaacatataccgcgtgcagatgctgtgtttttgaagtgtgttttgcacaactggaaggacgagcaatgcgtggagattttgaagacatgtcacgaggctacaccgggcaacgggaaggtgataattgtggatgcgattatcgaagaggaagtggggtgtgttcagcagatgggattgaggtctgacattgaaatgatggctttcaccgacggtggaagggagaggacggaggacgaattcaaaaagattttccatctagccggttaccgacgttacgtcatcacaaaattgccttcttccccttttagtatcatagagatattcaaagcttgaatggtgtaacgtatccaagtttaaacaaacacttgcatgcacaagtaaccatgcaggtgattatgttcttggcaatttgtaaggtattttatgtgtgatgtctggtttcataatggttgattctgattaatagtgtcacctctataaacttcacaattattttttggtttaattagatgatatttatgaaattgtgcgtatacaattttgttatttggctacaaagctatgacttccatggctttacgggatgagtgattccggttaatattttaaactttgaatgattgttttcacaaaatggtagcttaaatgtgtaattttgattgataataaaaaaaaaa

SEQ ID NO: 75 - DNA, 1379 bp, Pinus radiata
cggcgagggaaatgaaaggtatggctatggaagcccacgaggatgtcaagctgctagagtgttctggcatggatatcctagaagtgaacgaggaagcctccctgcaggcttcggccctgagaatggcgttttctatagcgaacccctttcttctaaaatgtgctcttagtcttaaaatccccgatatcatttggagagcgggcccggattcccctctctccgtccaacagattgcctcccaactcccctctgaagctcccgacatggacgccctctcgggcattcttacttgtctctctgccatgggaatcttgaaggcgatcaagccaacaaaagatgcccaggaaattaacggagcagccgaggccatgaccatgaaatacacgcttaccgatctcaccaaaacctacttcgtctctgaggacattagtcccttaagcctcgctcccctggctctcatgccaacccacgctcttctgatgcaaccctgggaccacattcacgagcgagtgctccatgtcggcgataatttcaagaattctagtggtcatggcaaggaattttggtcttatgtagcagccgaaccggaggtcaacaacgtcttcaacgcagcgatgctctcgctaacaaaggtggagatgagggagatcttaacttatgatggtttcaaggacgtcaacacgctggtcgacttgggcggagggcacggacaagtgatgagtcaaattatctccctgtatcctcacatccacgccataaattttgatgttcctcacgtcattgcaacagcacccactcttcatggtatcacacacattagtggagacatgtttgaaagcgtgccctcaggagatgcgattctcatgaagcacgtactacatctatgggatgatgaggactgcatcaagctacttaagatgtgttacaaggccacttccgataaaggtaaattaataatagtggatgcagttttagatacaacggaagatagtgatccaataggatctggtcaactcatggatatagttatgttgactgttttccctggagcaagagaaagaactcgggagcaatggaatggaattttacagtcagctggattttctttgtctaagatagtgggaaagaaaggaagtctcgctaaaattattgaagcactcaaatgctaagtggaggagcaaattctattttagtacaagtgctatgtgcaaagccaatttccatttcagtatcgtcgtttactgtagcaagtcagcttatgctttatttacgaagtataagatcgatttgtattttagttgttttgtttattgtagcaagtcacattatattttcatcattagattttataaaaatccacattccaatcaaaaaaaaaa

SEQ ID NO: 76 - DNA, 1485 bp, Pinus radiata
cgaacatcaaaaaggctgagaggttcgatgcattatcttttccctctctgattcgatctgtatctcgaagctgttttgatttgggagtccgatacgatggacagaaaagagtataacgtgcaggcacctccccctcctcctatggatttaatcttttctttcgctcctgccctcgctctcaaatctgctgtgctcctcaaaattccagatatcattgcaactgcaggccctgatcccgattcctctctctcgcttcgccaaatagctgcgcgcctcccaactcaaactccccatctcgattatctttcccgcattctcagatacctctccaccctcggcattttcattgaatctcaaacctcttctgaccctcttgattttcattatgggcttacacacaccgccaaatgttactttctcagcgatcataatgagaataagccctgcagtatggtgcctctccttctgatgcaaacccacgagaaattaatggcaccgtggcaccattttcatgaatgtgtgctccaaggcgaagggtgcgagggagctttcacgaaggcccatgggaaagatgtatgggcttattgcatggacgacccagatctgaacactgtcattaataatgccatggcctcatttaccaatattgtgatgataccatttctaagtgtttacgagggttttaagagtggagagaagttgacggttgtggatgtgggtggtggaaaaggaccggccatagctcagattgtgaaggcttatccccacatcaatgggattaactttgatcttcctcatgtcattgcaactgctccacctatttcagatgtacaacacgtgggtggtgacatgtttcacagcgtaccttctggagatgtcatctttatgaagcaaatactccatgactgggacgatgaacgatgcgcaaaaatccttgagaattgtcacagagctctgcctgagaatggcagactcgtagtggttgagatcgtggtgtcacaggatgagcagaaccgaagtcaacacgttgaaatggtggcaagtttgactatgctagcgcatactaacggaagggaaaggaacgagcaacagtggaggagattatttgaaagctcaggcttctctacactaaaaatggttgggctacttggaaatacacacttcagcgttttggaggctaccaaggccaagattcactgagatggattagattgaatgacagtcctgatttactatgtcagcagtgcttacatcttagtcagaggccatgttttggtttgctatttagtgttttacagaaacatgtcaaagcactgggaggacaatatattgtacatctgaatttaagtgtttctggagatcagttatgcttttattaattagtgtaagtatataagaagcaaaagggttgctgagcaacaagtctctgttttaggggaggggaatgtagtggttcataataaatatatttaggcaaaaaaaaaa

SEQ ID NO: 77 - DNA, 1250 bp, Pinus radiata
  modified_base (46): a, t, c, g, other or unknown
gagaatcgatcatgggcagcaaaatgtatggtgatgggttcttcgnatagcgaagaagaggaattgttagggcaggcgcaggcatggaggtccacctttgcctttgcggaatcgctggccgtgaagagtgcggttctgctgggaatccctgacctcatagcccgccaaggtccacacggtactctatctctcagagaaatcgtggcgcgcctccccagagaaacaccggacgcttcgtgcctcttcagaatcatgcgcttcctggctgcgaagggcgtgttccgagcctctgtagattccgatggaggcaacgagagcacgagatacggcctgacgcccgcgtccaagtggctggtccaagaatccagggagctgtcgatggcgccgatgctcttgatgcagaacgacgagagaagcgtagcgccgtggcaccgtttcaacgagtgcgtgctggacggtggcgtggccttcgagagggccaacggtgccgaggtctgggattatgcctccgctcatcccgaattcaacgatcttttcaacagcgcgatggcctgcaatgcgaggatcgtgatgaaggctatactttccaagtatcagggtttccatggtctcaattccttggtggacgtcggcggcgggactggaagcgcggtggcagagatcgtgagatcatatccttccatcaaatgcatcaactacgatctccctcatgttgtggccactgctccccatcatccaggcgtggagcaccagggaggagacatgttcaaaaccgtgccgctcgccgaggcaatattgatgaagtggatcatgcacgactggagcgacgaggaatgcatcaaaatactgaagaagtgcagagaggccatcccggagacagggaaagtcatcatagtagacgtggtgctggatgcaagcgatcaagatgagaaaaggaaggcggttatggatccgactataggcatcgcgtttgatctggtaatggtggcgcacagttcgggcgggagagagagaagagaggaagagtggaagaagattttattggaaggtgggtttagccgttacaacattatcaccattccagcgctgcagtctgtgattgaagcgttccctcgttgagcgccgtcatgtatgcaaaattgttcattagagtgttgcagtctgtaactgaagcgttccctggttgagcaccgccatgtttgcatatttgcagaataagaaatcctgtttgattctgtttaaaaaaaaaa

SEQ ID NO: 78 - DNA, 1041 bp, Pinus radiata
ggtttcgagatatatagtgttgctatataattgtttgagaatgggattcatgagaagcgttagaatagcgttcccacaaatcatgtcaaggttctggtcattctttgcacttctgtgtagcaaaagggcaaggctgccaagccaatccccggatggcagagaggcagtcctgctaaactatgttctgaaaaattcagagaagggaaatgcagagtctgtgctgagtgccattgagagtcatgctcagcaaacttggctgatgaatttaggcaaggagaagagctctgtgctggatggtgcagtgcagaaatttgatcccaaagtggtcttagagcttggaacttactgtggctattctgccataagaattgcctccaagatgaaaaagccagacagcaagctggtctctatagaaaagaatccacagaattgtagtgttgccagagcaattattgaacatgcaggtctgtcatcaaaggtgaaggtaatggaaggaacactaggtagcaatttggaggaactggatgaaattttagaagaagagagagttccatactttgagttcattttcatggataactccaatcagtgttatttgtcagactttctgctgctgaaggacagaggaatgctgggaaaagggacaggcattgtggctaacagtagtacagaagaatttactggagcttctgatttcttcacttacctgagaagccatccggaggaattggagactgaagagcataagtgtagtgtggatccactatcactaccatccactgtcaccgtctccatttacaaggctgatctgcctatattcattcattagaaaatgtttgcatgcatgttttccatataattctttaagcatattagatgcataaatagtcatataagatagagcagagagcaacttattgtggatgggtgcatgtctaagtatattcacagttaggaattccaatttttttattgatgtactggtgtagctcactttcttgcttgagaataagattctttccaatttttccaaaaaaaaaa

SEQ ID NO: 79 - DNA, 1294 bp, Pinus radiata
gagcactggaagattttgattctgcacaattcaacattgcccaaggtacaataacattggtttctctaggtctcaacttttctgtagtctgtagaaattcgtgtcaaggttgggttgagaatgattaattttacagaaattgctgcatagttatagcacttggcatcaattgaatgtaatgtgctacattattgcagcactgcctggttctggatctgctttcaattgtcaaagatggcaagcagagctgttcaacagacagaagtgaaggcggaaacaacccaaacagaggagccgaccaaggttgctcgccatcaagaagtgggccacaaaagtcttttgcagagcgatgccctctatcagtatatattggaaacaagcgtgtaccctcgtgagcctgcgccattaaaggagctccgagaagtaacggccaaacatccctggaacctcatgactacctctgctgatgagggtcaatttctgggcctcctgctgaaacttattaatgccaagaacaccatggagattggtgtgtacactggttactcgcttctcagcacagcccttgcattgcccgatgatggaaagattctagccatggacattaacagggagaactatgatatcggactgccgattatcgagaaagcaggagttgcccacaagatcgactttagagagggcccggctctgccccttttggatgaaatgcttcaaaaggaggagatgcatggatcgtttgatttcgtgttcgtggatgctgacaaagacaactatttgaactaccacaagcggttgatcgatctggtgaaggttgggggagtgattgcatacgacaacactctgtggaacggatcggtggtggctcctcctgatgcgcccctgagaaaatacgtgagatattacagagatttcgtggtggagctgaacaaagctctggctgccgatccccgcatcgagatcagccaaatcccagtcggcgatggtgttaccctctgcaggcgcctccattgaacttcatccattgaaggaatttggtaggcaactatgtatatcactatattatatgcattttctcgagatgtctaatctcatttgtgtcccacctccctggaccggctaatgatttgactatctttgttttaaaggaagcaaacttggtgtaggattctctccaacttcaatgatgcaataagcaagaggataaatgtcattatctttcatggacggagcacaaatggctttttacactctttgaaagtgaatcagatataatgatttaataaaaaaaaaa

SEQ ID NO: 80 - DNA, 1740 bp, Pinus radiata
ggtgaattcaactttggcataaaccaaactcaactacggtaatgcggttggtgtcggaatccaacaacttccaggaaaatgcgtgacaccatgattgattgagccgacaccgtccaccctggtcactttccggggttggtaaagagtaggtggcttagatcgttaacactagcgattaggtttagcgggacctgttcaaaaggaaattgggtaagaggtcgcgagttcgagctcgattggatggggtcccgtggtcaaactgacagcgactgacacacagcacatgaaattagcaagggattgggatgatttcgataggactgtcgatcagaacgagaagttcaagcaaagttttgatggtcaaaacagtaaggcaacgccaacctaccaactcccaatgggccctcccaggagccctagtcatccccactatctcatcttcgtataaagatctgcccacattctgctattcctccacacaattcgtcttcggcatttttctctttgaggcaacctacattcattgaatcccaggatttcttcttgtccaaacaggtttaaggaaatggcaggcacaagtgttgctgcagcagaggtgaaggctcagacaacccaagcagaggagccggttaaggttgtccgccatcaagaagtgggacacaaaagtcttttgcagagcgatgccctctatcagtatatattggaaacgagcgtgtaccctcgtgagcccgagccaatgaaggagctccgcgaagtgactgccaagcatccctggaacctcatgactacttctgccgatgagggtcaatttctgggcctcctgctgaagctcattaacgccaagaacaccatggagattggggtgtacactggttactcgcttctcagcacagcccttgcattgcccgatgatggaaagattctagccatggacatcaacagagagaactatgatatcggattgcctattattgagaaagcaggagttgcccacaagattgacttcagagagggccctgctctgccagttctggacgaactgcttaagaatgaggacatgcatggatcgttcgactttgtgttcgtggatgcggacaaagacaactatctaaactaccacaagcgtctgatcgatctggtgaaggttggaggtctgattgcatatgacaacaccctgtggaacggatctgtggtggctccacccgatgctcccctgaggaaatatgtgagatattacagagatttcgtgatggagctaaacaaggcccttgctgtcgatccccgcattgagatcagccaaatcccagtcggtgacggcgtcaccctttgcaggcgtgtctattgaaaacaatccttgtttctgctcgtctattgcaagcataaaggctctctgattataaggagaacgctataatatatggggttgaagccatttgttttgtttagtgtattgataataaagtagtacagcatatgcaaagtttgtatcagagtgttgattatgttttcttcgccatttcgatttgtgggcatcgaattttgtcctctgtatttggaaaactgcaatttaccagagaaaaacttcacgaatttctacagaatttaagttggtaaaaaagaaatagaattgttatagtagcaaaattgttttgctaaaattgcaatttgaaaataacatgaggttttcacagtttctgaatcaatctaggttattttcaaacttaaaaaaaaaaaaaaaaa

SEQ ID NO: 81 - DNA, 1159 bp, Pinus radiata
accggcttctgagctctcgatcctcacaggccctttttatttccctggtgaacgatacgatgggctcgcacgctgagaatggcaacggggtggaggttgttgatccaacggacttaactgacatcgagaatgggaaaccaggttatgacaagcgtacgctgcctgcggactggaagtttggagtgaagcttcaaaacgttatggaagaatccatttacaagtacatgctggaaacattcacccgccatcgagaggacgaggcgtccaaggagctctgggaacgaacatggaacctgacacagagaggggagatgatgacattgccagatcaggtgcagttcctgcgcttgatggtaaagatgtcaggtgctaaaaaggcattggagatcggagttttcactggctattcattgctcaatatcgctctcgctcttccttctgatggcaaggtggtagctgtggatccaggagatgaccccaaatttggctggccctgcttcgttaaggctggagttgcagacaaagtggagatcaagaaaactacagggttggactatttggattcccttattcaaaagggggagaaggattgcttcgactttgcattcgtggacgcagacaaagtgaactacgtgaactatcatccacggctgatgaagttagtgcgcgtggggggcgtcataatttacgacgacaccctctggtttggtctggtgggaggaaaggatccccacaacctgcttaagaatgattacatgaggacttctctggagggtatcaaggccatcaactccatggtagccaacgaccccaacttggaggtcgccacagtctttatgggatatggtgtcactgtttgttaccgcactgcttagttagctagtcctccgtcattctgctatgtatgtatatgataatggcgtcgatttctgatataggtggtttttcaatgtttctatcgtcatgttttctgtttagccagaatgtttcgatcgtcatggtttctgttaaagccagaataaaattagccgcttgcagttcagcattatgggattcatattgctgggcatgagggcaaattgagtgtctggttttctgaaatttcgtcttctcttgttaagattatggattaatatttctgaaaaaaaaaaaaaaaaaa

SEQ ID NO: 82 - DNA, 955 bp, Pinus radiata
ttgggatgtatgcttgaaccagggtagaacgttggtgttattattcgttctttttcttccccaatttgcagagagctcgtgagtcgacatggctatggcaggtttatccacgtttttttcattcgtaagagcacagacgaacctaaaagcgttgattgggaccgggcaagcaggcgacgggcgagagaaagcgttgctcgaccacgtcctgcagacggcagagaggggcaaccctcagtctgttttgcaggccatcgactcctacagcaggcgcaccagctggctcatgaacatcggcgacgataagggcccctttctcgattccgcccttgcaaaatacagtcccagggttgccctcgagatcgggacttactgcggttactctgctgtcaggatcgcgtcgcagatgcaaaggccgaggagtatgctcctcgctgtggagatgggccccctcaattgccaaatcgccacacaaatcatcgaccatgcaggagtattgtccaaggtgcgagtggtggaaggaaaattcgatgagcgtttgggcaccattaagcaatttctggaagagatggacgctcccttcttcgaattcgtctttctggaccactggaagaaccgttacatgccggattatctgctgctgaaggagcagggcttgatccggaagggaagcgggatatttgcagacaacatgggtcctctcattggaccggcagacttcagaaagtatgtgaagacgcatccagaggagcttgagacacaagaatttaagagcaacactgaatacatgaggtggatgcccgacagtgtcactgtatcaacctatatgctagactagataggtagtcctgtcaatattcttggaaaagataggtagtcctgtcaatattcttggaaaggccgttagggtgttttcttgcaataatatttttcaggtttgaagttaaaaaaaaaa

SEQ ID NO: 83 - DNA, 1116 bp, Pinus radiata
ttagggtttcgaagctatacaaatttaatcacctcgtaacttccagttagaccacctgtgtaaggaaataacacaggcacagatgttcaacacctagctgcagcagacgtgcaggtggacttaatccccaaggacaggagcagagtaaggttgcgatccatcagaaaatggatcacaaaagtctgttgcagagtgatgccctctatcagtatatattggaaacaagcgtgtaccctcgtgagcccgagccattgaaggagctccgggaattgacttccaaacatccccggcacgtcatcgctattcctccaggtgaaggtcaatttctgggactcctgttgaagctgatgaacgccaagaacaccatcgagattggggtgtacactggttactcacttctcagcacagcccttgccttaccgtctgatggaaagataatagcgatggacattaacagagcgaattatgatatggggctacctatcattgagaaatctggagttgcccacaaaattgatttcagagaagtccctgctctgcctcttctggatgaaatgcttaagaatgaggagatgcacggatcgtttgatttcgcgtttgtagatgctgacaaagacaactatctgaattaccacatgcggctgatagatctggtgaaggtcggaggattgattgtgtatgacaatactctgtggcaaggatccgttgcgcttcccccagaagtcgccattagcgaaggcatgagttatggggaagacagagagcatatgttggaactaaacagggcccttgctgcagaccctcggatcgagattgctcagatcccaattgccgatggtgtgacgctgtgcaggcgcctttcctgaacatttttcagcgatcttgtctggcatgtgagaatctgaaattgcaagcatatacaactctaaatacatcaatgtgtcaaattgttaatgatttgaatctgcatgaatgttctttcagtgatctgattccttgttcctctttgatatcaatttacaatttgaatggatgaatttatatatactatcacaatgatatcgtaatgattttttttttcaatggaaaaaactacttttttcattaaaaaaaaaa

SEQ ID NO: 84 - DNA, 1085 bp, Pinus radiata
agagagattttcgttttagggccaattgcatagagccgattgcggaagtccgacgcgattgtttgattgggtttaattttttgtagttttatttgttattatatatgttttcagctgtgttgaaggtgtaaggatataacatccagctgcagcaaacgtgaaggtggactgaactccaaggacaggagcagagtaaggttgcgaagcatcagaaaatggaatacaaaactctgttgcagagcgatgccctttatgagtatatattggaaaccagcgtgtaccctcgtgagccagagcccttgaaggagctccgggaattgactatcaaacatccctggcacggcatggctattcctccagatgaaggtcaatttctgggcctcctgttgaagctgatgaacgccaagaacaccatcgagattggggtgtacactggttactcacttctcagcacagcccttgccttaccgtctgatggaaagataatagcgatggacattaacagagcgaattatgatatggggctacctatcattgagaaagctggagttgcccacaaaattgatttcagagaagtccctgctctgccacttctggatgaaatgcttaagaatgaggagatgcacggatcgtttgatttcgcgtttgtagatgctgacaaaggcaactatctgaattaccacatgcggctgatagctctggtgaaggtcggaggattgattgcgtatgacaatactctgtggcaaggatccgttgcgcttcccccagaagtcgccatgagcgaaggcatgaattatggggaagacagagagcatatgttggaactaaacagggcccttgctgcagaccttcgcatcgagattgctcagatcccaattgccgatggagtgacgctgtgcaggcgcctttcctgaacattattcagcgatgttgtcctgtatgtgagaatctgaaattgcaagcatacacaactctaaatacatcaatgtttcccattgttaatgatttgaaattacacgaatgttcatttctaagccggaacaagtgatctaattcatggttactttttaatatcaaaaaaaaaa

SEQ ID NO: 85 - DNA, 969 bp, Pinus radiata
aaatggctcagcagtgttcagggcgtgaggaaataccagggacaacagatgttcaggcggactcaacccaagcacaagatgagggtaatgttgctcactaccatacaatgggtcacaaaagtctgttgcagagcgatgccctctatcagtatatattggaaaccagcgtgtaccctcgtgagcccgagccattgaagaagcttcgggaagtgactgccaaagttcccgggaacgttatggccattcctccggatgaagctcagtttctgggccttctactgaagctaatgaatgctaagaacaccatagagattggggtgttcaccggtcactcacttctcagcacagccgtggccttacccgatgacggaaagataatagccatggatcctgatagagcgacttatgagatggggcgacctatcattgagaaagctggagttgcccacaaaattgacttcaaagaaggtcctgctctgccatttttggatgaaatggtcaagaatgttgggatgcacggatcgtttgattttgcgtttgtggacgcggacaaagggaactatctgaactaccacgagcggctgatcgatctggtaaagatcgggggagtgattgcgtatgacaacactctgtgggaaggaagcgttgcggctccccccacagatgacatggacgaagggttcagaaatatgagaattttcatattggaagtgaacaaggtccttgctgctgatccccgcatcgagattgcccaaatcccagtcgccgatggaatcacgctgtgcaggcgtctctcttgaactttattcagcaaggcgatatagggttaatctgaaattcattactgtcaaagaatctaccagtagaaattgttcgtgaaaatatgtttgttaggggtttagttatcagtatttgagttcgaagtaccgattagcataataaatttattattttcatgtaaaaaaaaaa

SEQ ID NO: 86 - DNA, 951 bp, Pinus radiata
acattacccatctctgttctctgaatagattcaagccatggcaggcgatcttgtgtcaaagttattgtcatattttacattttccaataatacgcaagcatggctgactggcaattcccctgatcacagagagcacgccctgctaagccatgtcttgcaaactgcggagaagggaaatgcagagtctgtgctgaaggccattgtcgattttaatagccatacctggctgccaattttaggtgaggagaagggttttattctggatgctgcagtgaaacaattcaatcccaaagtggccttagagctcggaacttattgtgggtattctgccattagaattgcttcaaagatgggaaagcgtggcagcaaactggtttcaatagaaatgaactcagataactgtgcaattgccagagcaataatagagcacgcaggattgtcctcaaaggtgacagtgttgaagggaacattgaaggaagtgattggtggaatagagagtgaaatgaatatcctaaactttgagttcatatttatggatcacttcaagaactgttatctgccagattttctgttactcaaggacaaacacatgcttaagaaaggagcaggcattgttgcagacagcatcggatttcccgaggccctggattacttgaaatatttgaaagaacacccccaagaattgaaaactgaagaacgcaaatcggatgtgaagttcttgaattggttgcagtgcaaaatgacagtgtccacttatgaggttggggaagatgatgacattgttcagttaattgaattggtgggttgaatatctaaatgaccagctataggtcattcttggtctcctttcatcaaatgccttataatggatgattttgtgtttgaagtggaagtcatgatcaagtaaattaaagactgaagattacacattttcattatttaaaaaaaaaa

SEQ ID NO: 87 - DNA, 1281 bp, Pinus radiata
gagaggatcggccaagtatgacaggccttctctgcggcggtagaaatccgaacgccttatcagctatttgcttgcatccagcctctagtgcgaagccattgccactaaaccctccattgatatcgatatggagatattcaaagacaaaggcagtgggagtgaaactgggttgctatggtgtttcatcaaggcgacatgtcagcactgatagaaagggagtggtcatttcaagcgacgataagtatggaaacaagcaggtggtgtctctcactccccagttataccactatatattggccaacgttcgcgaaccacagattctacgggagcttcgtgaagagacatcaacgatggcagggagtcagatgcaggtatcccctgatcaagcacaattacttgcaatgcttgttcaaacgctgggggcaaaatggtgcattgaggttggagtatacaccggatattcatctttagctgttgccttggtgctacctgaatcaggtcgtctagtggcttgtgaaagagatgaaaactgtcttgcagttgccaaaaggtattatcaacgtgctggtgtctcccacaaggtggatgttagacatggatttggtatagatactttacaagatttgcttcagaatggagaagctaatagatacgattttgcatttcttgatgcagagaagcggatgtactttgattactatgagctgcttctacaattgattaggccaggtggtcttatagtcattgacaatgtactatggcatggaagggttgctgatcccttgatcaatgataaaaagacaattagtctacgagactttaacaaagtagtttttaacgatgagcgtgtaaacattagcatggttcccattggagatggaatgactctatgtcgaaaaaaataacccttgaagtatgaccttacctatttattttctaattggaaacttagatgcctcttaattagttaaatgaatcaaatttcataatattaaaaatgtgccccttgaaacaaatctctatgtcataatgaatcaaagattggtcttaattcacttaagggattggagtgttagtaaggccaattcatttaaggtagtatatgtggttgtttctcaaggggaataatctaggaatttggtctttgagaattgtccatctatatatatatatatatatattagaagactttatgtctactttcggatggagtttcgttggaatagatgtaatttgtaactaattaagaagcaacattattattgacggttaaaaaaaaaa

SEQ ID NO: 88 - DNA, 1536 bp, Pinus radiata
gattgatttgcagtgggcgcaaggaatgccatggacttgggaggcggtgttgagaagtcattttgaaatttttaccagccgaccatgtgctctatatctttttcctacgaaagtcactttcggtgacgaggcagggggcagatggcagggcagctaggcagcctgcgacttaggcattcacaggctaagaaaccgtaacgtcaccagacttttcctgttttgaatctcagaatagttgcgaaaggaagcgatgacgaagtacgtgatcgttagctccattgtgtgtttctttgtatttgtttctgcgtgcataatttctgtcaatggattagttgtccatgaagatgatctgtcaaagcctgtgcatgggctttcgtggacattttataaggacagttgccccgacttggaggccatagtgaaatcggtacttgagccggcgttggacgaagatatcactcaggccgcaggcttgcttagacttcatttccatgactgttttgtgcagggttgcgatgggtccgtgttgctgacaggaactaaaagaaaccccagtgagcaacaggctcagccaaacttaacactgagagcccgggccttgcagctgatcgacgaaattaaaacagctgtagaagctagctgcagtggggttgtaacttgtgcagacattctagctttggctgctcgtgaatccgtcgcccaggcaggaggcccaaaatttccagtaccacttggacgcagagatagcctaaagttcgccagtcaatccgtagttctcgccaatataccagctccaactttaaatttgacacagctgatgaacatttttggctccaaaggattcagtttggccgatctggttgctctttcaggtggacacacaatcggcattggtcactgtaactcattcgataaccgattatataacaaggccacaggaaaaaaaattgtggatccaagtatagcaaacagtttggcagacgatctttattcattatgccccactgttaataacaccgtggacttcacaaacttggatatccagactccgaacgctttcgacaagaaatactacgcgaatgtgcagaagaaccaggtgctattcacctccgaccagagtctctacaccgagaccgatagtgcagaaatcgttgacagctttgcatccagccagaccgtgttcttcaaaaagtttgtacatggaatgcataaaatggggcagttggatgttctaacgggcaagaagggagagatccgtaccacatgctccgttccgaatccgacttcttcagcctttgaagaagttatcgagcctgtcacccactcagagctttagcttctggtttaaacttaggaataaggttaatgatgttcatgtctttccctttcttagtatggccacacgcttatatggattgcagatttgctcccagttataatgtttatgtttatgtttttgacaggataaatataaataaataagcatttgtaaataaaattttcaaaattttgttattcaaaccagtaaaaaaaaaa

SEQ ID NO: 89 - DNA, 1466 bp, Pinus radiata
tattcgcctggccgggagattgtagccactactggacaacgtcgtaatgcaaattcaggccgtcggatttggaatccaatgggtgacagcgagctactagattgttctgctgacacagaacagcatcctgtagaacaatcatgtcgaacctaccagactacctcagttttccaatatagtctggtgaaggaacaacatcgccactcagtaatttggagttaaaggaattcgaatcgcagcgggtccagttcgaattgtgctgggatcttgcaaagaggtcgagatgtataagcgatatcctacagtaagcgaagaataccagaaatccgtggagaaatgcaagaggaagcttcgcggcctcattgcagagaagaaatgcgctccgatcatgctccgtctcgcatggcactctgctggaacttatgattttaagaccaagacgggaggacctttcggaaccattaggcacccggatgaaatcgcacacaatgccaataatggtcttgacattgcgatcaggctgctggaacccatcaaggagcagtttcctatgatttcatacgccgatttctatcagctcgctggtgtcgtggctgttgaaattacaggagggccggacatccctttccatccaggaagaccagataaaactgagcctccagaggagggccgtttacctgatgccactaaaggggttgatcatttgagggatgtgtttggtcacatgggcttaagtgacaaggatattgtggccctttctggtggccacaccttgggtagatgtcacaaggagcgatctggctttgagggtgcatggacgtccaatcctctgatatttgacaattcctatttcaaggaacttcttagtggagagaaggaaggtttgcttcagcttccttccgataaggcattgttggaggatccgattttccgatcttatgtggagaagtacgcagcggatgaggatgccttttttgctgattatgcggaagctcacttgaagctctctgaactggggtttgcagaggaggagtaaacgctgagtcatggaagtgcatacgctgtgtaaaacgcaaaacatatgatgctacctgcagaatggcatctctagaagagccataagagttgatgttgtgtaaaacatatcctaatagcagtgtcagaaatagcctctcgcagtatgcattctgttcagtttagttatgtctattttgagtatgccttgctgttgttggttagagtcttgacagagttgatgagagagtgctctgattccattgcctcgtgctctctcgtctctgcttgtgttggttctgtctacgtcattatgtcaggagactcaataaaaggcaagtaagatgattcatgtgtatagtttataataacgcacctggctgttggaattaatgtatttatgtgactcctaccagtcaattttcttttcaagataaaaaaaaaaaaaaaaa

SEQ ID NO: 90 - DNA, 1322 bp, Pinus radiata
atcgtgtgtgatagagagctcagagcagagtcgggttggagtgttaaatcagcatattaataatcagtatggcgaagctgatgattttttgtttgttatgcactctctgtatcgcttatgcgataagagataatgtcctcactctcaatgccgatccgccccttgtaaatgggctgtcatggacattttatcagaagagctgtcctcaattggaatccattgtaaagaaaaggattgatttctacctcaagcaggacatcacccaggcagctgggttgctgcgactccatttccacgactgtttcgttcagggctgtgacggatcggttctgttggacggatcagcaagtggccccagcgaacaaggggcttcgcccaacttatcgctgagaaagaaagccttcgaaataataaacgacatcaagagccgcgtggacaaggcttgcagcgttgtcgtctcctgtgccgacgtcaccgctctcgcagctaaagagtcggtcagggcggcgggagggccacagtaccgtgtaccgctagggcgcagggacagcctgaaattcgccacacaaaacgtgacggttgccaatctcccggctcccttctttaaggtgacagcgctcatcaatgcttttgcctccaagaatctcaacgtcacagacctcgttgctctttcaggcggacacaccatcggcatggggcactgcacctccttcaccgaccgtttatacccgacgcaggacactagtttgaacaaaagcttcgcccagaggctgtacaccaagtgtccttccaagacctccaccaacaccaccgtgttggacattcgcacgcccaacgtgttcgacaacaaatattacgtagacctgatgaaccgggagggcctgttcacctccgatcaggatctctacaccgactcccgcacaaaagcaatcgtgaaggagtttgccctgaatcaagatcttttcttccagaactttgcagtggccatggtgaagatgagccagctcaacgtgctcaccggatccaaaggggagatcaggcataactgctccgctagcaatctggcttcgacgatcgaagtggcggtagaagacgttattgaatcttatgcgtcattcatgtaaatgcaggcgcgacggccatggctggtctttcagaggttcttatgtgcgctttttcgatgtgtttttttgtttccaaagttcggtctatcgttttacatgtacacagtgtgacggacgtctcttaacagatgccttagaaatcgtactctcagctctcaacaaaataaaaacacactactgctttggacaaaaaaaaaa

SEQ ID NO: 91 - DNA, 1391 bp, Pinus radiata
tcagttcaccaacttggactttctggaagggcaaaagagaaatgaaaatatctaatcctagcccgctccaataactagaggaagccaactgattctgatccgattggctatcgttgtctctattccatctgccagtttcacaatcatgccgatgggtccagtggtggacgccgcgtatctcaagtccattgacaaggcacgccgagacctgcgggctctcattgctgaaaagaattgcgcgcccatcatgcttcgtctcgcatggcatgatgcaggcacttatgatgcaaaaacgaagacgggtggggcaaatggttccattagaaacgaggaggaactcaatcacagtgcaaataatgggctgaaaattgcacttgcattgtgtgaaccaatcaagggaaagtacccaaatattacttatgcagacctttatcagctggctggtgtagttgctgttgaggttacgggaggtcccacaattgagtttgtccctggtcgtaaggattcactggcatcaccacgagaagggcggcttcctgatgcgaagaaaggttcacaacacctaagggatatcttttataggatgggcctatctgacaaggatatagttgctctttctggagcgcacacattgggaaaagcacatccagaaaggtcaggctttgatggagcatggaccgagcagcctctgaagtttgataattcatattttgtagagcttctcaaaggcgagtctgaaggattactccaattgcctacggacaaatgcttggtagaggatcccagtttccgcccttatgtggatctttatgccaaggatgaagatgcgtttttcaaggactatgcagagtcacacaagaagctttctgaattgggattcagagatccaagctcacttccctctggttctggttctgaagtgagcacatctacagtgcttgcacaaggggcagttggagtagtagttgctgctgcagttgttatttttggctacttatacgaggctaaaaggaaatcaaagtgagtgtgctgcacgggaaattcagatgttggatactgcaattatatttagcataaatattctgaattgaatgttctattttcttttgagtaggtactgacaggttccatgcagcccacgctctattgtaatcacgagttttaaacttatgcttagttattatatatatgataccattatttatgactagattagattcctttttatcccctattctaaacttgttggatctccaactctggcactaatactgtgaatttaacagtgaataagaaacaataatggctggcgtggttatcgttgtatattttttaaaataatgttaggaaaggagggataaatctttaacgtatgcatttgaaaaaaaaaa

SEQ ID NO: 92 - DNA, 1643 bp, Pinus radiata
ctattcttcacaagcctgtcagtttgagtgccttttcctttacctaataaaatatcaccataagcctgggcttaggtggggggagctggaaagctttatttatataaggctcatttccatacaaactagaaggcaaagttccagacttttgcatcgtccggaaacagtagaggtttgctttagctttcattgtaatggcaggcacttctggccttagactgcagtttcgccctgtgcttatcacgggactggcactgatgctatggatccaggcaatacatgctcaaagctctaatggtttgactcccaactattatgacaaatcctgtcccgaggccttgtctatcattaaatctggtatagaagatgctgtgaaacaggaagcaagattcgctgcttctttgcttcgtctgcattttcatgactgctttgttaagggttgtgatgcttcgattctgcttgatgacactgccaacttcacgggggaaaagacagcaaaacctaacctgaattcggtcagagggtttggagtggtggataagatcaaaagtgcactggagaaaaaatgccccggagtggtgtcatgcgctgatcttcttgctgtagcagcccgtgactctgtagttattagtggaggacctacttgggaggctctcttgggcagaagggactccagaagtgcaagcaagagcggtgcaaactacaacattcctgcccccacatcaacccatcagacactagaaaccaaattcaaactcaaaggcctccattcacttgacctggttgttctatcaggggggcatacaataggtttatcgcgatgcacaagcttcaaggcaaggctgtacaataatagtggaactgcgaaacctgacccaacattggacaccacgtacttgaagcagctgagaatcgagtgtccccaaaatggcaccgacgacaatcaaactgtaccgttggatccggtcactccttttaaattcgacgtaaactactacaagaacattgtggccagtaaagggttgctcaattcagatgagattctgtattccaccaatggaagtaaaacagcagcttatgtaaaattctacacaacccacacccaagctttcttcaagcaattcgctatttcaatgataaagatgggcaacctcagtcctctcactgggtcccagggagaaattaggaagaactgtcgtaaaatgaattgaccgaattgtttggccatgaataagtgcccgacaagagattaataaatgtgatatatgttgggggatatttggttggctctgaatgtcagttaatttaaaaatttcaacgaaaaggcccacctcgtttgatcatggatcaattacgagtgtgcccacagtggattttctccttttgtaatagtagtcgtggaagtattctagccggttatcagtcacaagtttttgagatccctagaggactcaacgcccattggcccaaagtgtcgttttattttatagggtgtttaggaaattcgagggcgtcaatgggcgtttggaatttttaattcgttgtacaatctctatggtttctttacaaattcgcatcaataaagtttctcgccattgtcagggagacattttttctttgttataaaaaaaaaaaaaaaaaaa

SEQ ID NO: 93 - DNA, 1489 bp, Pinus radiata
gctgttatccacctaaatttgactcatgttttgtctgatccagccattatattccagccaccagcccatctttttcattcattgttatataagagaggtatgcaggtttgtgcgtaatacactaggccaggggctcttatcttgtgagttctcagataaggtattgtcatgggttcaaaaaaatctgctaggaagccattggaattggctggatttgtcatttgggtattgttagggctgtgtgtaagcaatggatcggctcaacttagtgagaatttttatgcaaaaatctgtcccaatgttgaatccattgtaaggaatgttgtttctcaaaagtttacccagacatttgtgacagttcctggcacattacgactcttcttccatgattgctttgttgagggatgtgatgcctcagtgattattcagtctacatcaaacaacactgctgagaaagatttttcagacaacttgtcattagctggtgatggatttgatactgtcatcaaggccaagcaagctgtagagaaagtgtgccccaacagcgtgtcttgtgctgatatcctaaccatggctgccagagatgttgtagcattggctggaggcccacaattcaatgtggagttagggcgacgagatggattgatatcccaagcctccagagtcaatggaaacctgccaaaggcttcattcactctcaaccaattaaactttctatttgcaaggaagggtttgagtcaaacagacatggtagctctatctggagcccacactctgggattctctcactgcaaccaatttgcaaacagaatctacagtttcagtgctagtacaccggtggatccaagtctgaatgcgtcctatgctactcaacttcaacagatgtgccctaagaacgtggacccgaccattgctattaacatagatcccataactccccgcaaattcgataacgtttattaccagaatttacagtctgggaaggggcttttctcatctgacgaggttctatacacagacctgcgcacacgaaattctgtaaacaaatttgctcagagttcagatacgtttaacacggccttcgtgagcgccatgaggaacttggggcgtgtggacgtgaagacgggattccagggcgagatcagacaagattgcagccgatttaactaatcctaccggacctgcattgcgttgcatttattcttttgtattttctatgggagttagtggaacgagacaatggcagttgcttctttccttttcatttctcaataatccccgccgcctgctggggtaggtggtttctgtgtagcgttcattcattgcgttgggttgtgctcaaaagacgtgcaattaccattaactaataaagtatggaaaccatactttatccattggattttgaatgttcggcaatcatataaaactgaagaacatgtctttttaaaactatacagtataatgacatcatagaacggcaaaaaaaaaa

SEQ ID NO: 94 - DNA, 1136 bp, Pinus radiata
ctccagttatagggttcgtcatggcatttcgatatgtttcactgaatgttatattccttgcatttgcattcattcaaggcaccactgctcagctctgccctaccttttatcagaatacatgtcccaatgtcaccaatatagtggggcaggtcatccagcaggctctgcaaaatgattcaaggattgcggcctctctccttcgtatgcattttcacgattgctttgttaatggctgtgatggatccgttctcttagatgacacagcaaattttactggagaaaagacagcaggtccgaataacaattccctcaggggcttcgatgttgtggacaacatcaaggcagcagtagagagtgcatgcaacgcaacagtttcttgtgctgacattcttgccattgctgcagagcgatcagtcgtactgtccagtggtccatcgtggactatacacttaggaagacgagatagcactactgcaaatgcaactcttcctaacacagccattccggcaccaacagacaatgtttccacaattatagcaaagttccaaaatgtgggactttctgtcaccgatgtagttgctttgtcaggtgggcacacaatcgggcgagctcgctgcacagtttttgtcaacagactttacaatttcagcggaacaggcaatccagatccgacgctgaattcatcttatctatccaccctgcaaagcacgtgcccacagaatggtaacgggagcaccctaacctcacttgatccgtgcactccaaatacctttgacaacaactactacataaatctccaaaacgaaatggggcttctgcagtcagatcaagaactgcttaacacaacgggggcagccaccatttctattgtgaatgactataccagaagtcaggctgattttttctccaacttctccaactcgatgattaacatgggaaacataaatcctctaacgggaacaagcggagaaatccgtctaaattgcaggaaggtcaatggctagaaaatcacaatatcgctttgtttcgtctgtttccacttttgtaacataaaagttagaaagggaagtgcgtgctatctgtaacatactgacagcaattatcaataaatttaattttggaaaacaaaaaaaaaa

SEQ ID NO: 95 - DNA, 1109 bp, Pinus radiata
ttcactcaattccattctgttcttcttttctttgaagcgcgcagcttttcctaaatataatgaggtctctcgtatgcatttctgtaatggtgtttctatgcgctattaataacgctgcgcatgggcagctgagtccaacgttttatgcgaagtcgtgtccgacggcgctgtcaatcgttaacgcggcggtgaagaaggccgtcgccagcgagaaaagaatgggggcgtcattgctccgccttcacttccacgactgcttcgttcagggctgcgatgggtcgatactgttggatgataactcaacctttaccggagaaaaaactgcaggtgcaaacgccaattctgtcagaggattcgacgtcgtcgacaccatcaaaactaatctggaggcagcctgcagtggagtcgtgtcgtgtgccgacattctcgccattgctgctcgtgattcagtcgttgcactgggaggtcgatcatacacggtacagctgggaaggcgagactcaacgactgcaagtttaagctctgcaaacagcaaccttccctcgccagcttccagtctcagcacactcatgacagcatttcaaaaacagggtctctctaccaaggacctcgtcgcactctcaggtgctcatacaattggtcaagcacggtgcaccacattcagaactcgcatctacaacgataccaacattaacgctgccttcgctacatctgcgaaggcgaactgccccagcactggtggcgacaacaccctctctcccttggatgttctcacccctaccacatttgacaacaagtattacactaatctgaaaagccaaaagggacttttccactccgatcaggagctatttaatggaggttccacagactctagagttagtatctacagcaccagtcaagccattttctttactgactttgcagccgccatggtgaatatgggtaatattagtcccctcactggcaccaacggcgagatccgcacaaactgcaggaaagtcaattaaaatttgtaaagattgtattatctatagcttttctctgaagttataagcgaagctagctttacaagaaagcaataaattactgtttaattaaaaaaaaaa

SEQ ID NO: 96 - DNA, 1414 bp, Pinus radiata
gccatcttgaacgcccaacgtcctacattttttcctctgaaagagaaagaaaatagcctaccggccctactaaccctttcacatgattaacagggagcttggcagcactgtatgaatctagttttagaagcagcgttaccaaacaatatataattgtgcttccaatggagtctgttcaaaggagataggcaatctaacctaatcttccatttccagtggcatagccattgcacataggacagcttaacttgctgctgccaagatgatgattggcattgggaaaggtagtacagctctaggtttcatggtggtagtggcaacattatgtgagctggtgccagtcaatacacaaggtactgtggtggggttttacaaacagacttgcccaaacgtagagagacttgtgcagctgagggtacagaaaaagttcagcactgataagaccattgtgcctgcacttcttcgaatgcattttcatgattgctttgtcaaaggctgtgatgcatccctgcttgtagattctactgctgcaaatcaagcagagaaggaggcagggcccaatcagacagtgagaggatttgaattcattgatgagatcaagaaggtcatggaagctgtatgtgccaacacagtatcctgtgctgacattattgcactggctacaagagatgccgtggccctggctggtggaccacgatatgatgttccaactggaagaagagatggtacagtgtccaaagtagatgatgcaaataaacttcctgatcccaacgatagtgccatacagtcctcttcagcatttgcttccaagggtctctctgttctagatcttgttaccctgttaggtgcacacaccgtgggcattacacattgcagtttctttaacgacaggctgtacaactttttgggcacgggcaaaccagacccaaccatggatccagcccttgtaaccaagttgaagaccacatgcccagatcctgcctcgggcagctctgcagacccccctataaatctggatcagggaaccccctctgttttcgataacagtttctacaaacagattgctgccaggagaggtatcttgcaaattgatcagcagttgttcgaggatgcaagcaccactaactttgttaggagtttcgcaggatcgtcaccaaaacctttgaatttcagccagcagttcgttcagtccattgttaagatgggtaagttgggagtgctcactggtaatcaaggaaccatcaggaaaaactgtagagttgtcaatacctgactgatgaattttgtctgtatcgattagctattcgtcgcattttcctggaatattaatgccatgccatgcaagctaattcagaaagttatataataaaatctggatgtcgggtctggttttctaaaaaaaaaaaaaaaaaaa

SEQ ID NO: 97 - DNA, 1375 bp, Pinus radiata
ctcgttggacctgcaaagcgtttgttatataagtatcatacaagcttaatgccaaaatctatactcttctgcatgataaggaaatagtttaggtcagtaatggcacggatgaaacatattcccggccttacactgcagtttcagtctgtgctgatcactggagcggcattgtttctatggatccagacatcggatgctcaggactgtaatggtctgagtcatcactattatcagaagtcctgtccaaatgcccaggctatcattaaatctgtagtttcagatgctgtcaaaaaggaagcgagaatggctgcttccttgcttcgtctgcattttcatgactgttttgttcagggctgtgatgcttcaattctgcttgatgacactgctagtttcacaggggagaagacagcattacctaacagaaattctgtaagaggctttgaggtagtggataagatcaaaagcaaattggaggaagcatgtcctggagtggtctcatgtgctgacattcttgctgtggcggcccgtgattcagtaggctttagtgtgggtccgtattgggaggttctactgggcaggagggactcaaagactgcaagcaagagcggtgcaaacaacgacattcctgcacccaactcaacccatcagactctggaaaccaaattcaacctcaaaggtctcaatgtgcttgacctagttgctctatcaggctcccatacaataggtttagcgcgatgcacaagcttcaaggcgaggctgtacaatcagactgtaaatggtaaacctgaccctacactcaacacgtcgtacttaaagcggctgagggccgtgtgccctcaaactggcaccgacgataatcgaaccacgccattggatccggtcactcccataaaattcgacattaactattacaggaacctggtagaaggaacagggttgctgcgttcagatgagattctgtactccactaaaggaagtagaacagcgagtttagttagattgtacagcaccaacacgcacgcatttttcaagcaattcgctgcatcaatgataaagatgggcaacatcagtcctctcaccgggtctagcggtgaaattaggaagaactgtcgcaaaaggaattgacaggcagacaactgtgctgccgtctgcatctgcatgtgcactgccattgttagttgttttctattaatgaacgaaaaggcccacctcgaccagcttcatatgagcatccgtaatttctctctttgctcggtgatttcgttccgtccaataattgtagctttcttctgtaatatcatcgccgtggaagtatatacttatacaatatctcaccgttcatatttatacgcaggcataatctctggcaattgcc

SEQ ID NO: 98 - DNA, 1256 bp, Pinus radiata
tgcaactataaaaaccattcaaacccaccgaagatttcattgcgtcgcagcatcatgacttcctttacagcaatggcgtcagtcgtgtgcatcgctctgctctttttttcgaccgttgcttttgctcaactcaactcaacgtattatgatacgtcgtgtcccaaactcctggcaacggtgaaggctgcagtgaagacggcggtggccaatgagaaacgcatgggggcatcattgctccgtcttcactttcatgattgtttcgtcaatggttgcgatgggtcagtgttgttggacgactcttcgagtctaactggggaaaagactgctcttcccaacaacaattcgttgaggggtttcgacgtcatagacaccatcaaatcacaagtggaagcagtttgcagcggaatcgtatcgtgcgctgacattttggctattacggctagagattctgtcgtcgaattgggaggaccaacatggacagtgctgcttggaaggagagactcagcaactgccagcctaagcgccgcaaacaccaacattcccgctcccacttccaatctcagtggtctcatctcatcttttcaagcacagggcctttcaaccaaggatatgattgtcctatcaggtgcacataccattggccaagctcgatgcacagttttcaggattcacatctacaacgaatccaacattaacgcggcatttgccacttccctgaagacaaactgcccaagtacaggaggcgacaataacctgtcaccgttggatctactgactccaacaacgttcgacaataaatactacacaaatctgaagagccaaaagggtcttctccactcagaccagcagctgtttaatggcggctctgcagattcccaggttactacctacagcaccactcagagcaccttctttactgacttcgcagcttccatgttgaatatgggtaatatcagtcccctcactggcaccagcggacaaatccgcaaaaactgcagaaaacctaattgatgcctctcttaggccatatgtactttactgttctcatgggattatattttgattgtagaattatatagatagttgggagacctacggctgcgttagacactagcaagcctccaattggatctgtgcgtccctagtttgttgactatttggttgatttcgatgtaccaagtacaaagtttctcaacagattaatccaatgaattaggttttataatttcaatgttcaaactgctttaaaaaaaaaa

SEQ ID NO: 99 - DNA, 1348 bp, Pinus radiata
attcaattcaattcaatccatctccattccattcccttctcttttctttttcctttccgggctataactagttaatttttctagtcatgaagactttcctattcattgctctctgtgtgctgtgtataagctctattaataacgttgcgcatgggcagctgacctcaacattttacagcaaagtgtgtccgacggcgctttcgatagtgaaagccgcagtgacgaaagccgtcaacaatgagaaacggatgggggcgtccttgctgcgccttcacttccacgattgcttcgttaatggttgcgatgggtcgatactgttggatgataactcaacctttaccggagaaaagactgcaggcccaaatgctaattctgtgagaggattcgacgtcatagacaccatcaaaactcaagttgaggcagcgtgcagtggtgtcgtgtcatgtgccgacattctcgccattgctgctcgcgattcagttgtccaactgggaggcccaacatggacggtacttctgggaaggcgagactctacgactgcgagtttaagcgccgcaaacaacaacattccgtctcccgcttcgaatctcagcgccttaatctcctcttttacagcccatggtctttctacaaaggatctcgttgcactctcgggagctcatacgattggccaagcgcggtgcaccacattcagagctcgcgtctacaacgaatccaacattgacacttccttcgccacttcggtgaaggcaaactgtccaagcgctggtggcgacaacaccctctcgcccttagatctggccacgcctaccacatttgacaacaagtattaccctgatttgagaagccaaaagggacttctgcactccgatcagcaactgtttagcggagggtctacaaattctcaagtcaccacctatagctctaatcaaaacaccttctttacagactttacagctgccatggtgaaaatggggaatatttctcctctcactggtaccaacggacaaatccgcaagaactgcaggaaggccaattaagggttatgaacatttttttcttcgttgtaacaaattcattgccaattggctaccgaaaaaaaccaataaactaaattgtggagagattgtgctgaaacaaaatgtaatctgcgatattgaagtgacatgtacattcagattaggtcttcaatacggttggaaaattcgtatgaagtatgtagcagactgaagtctaagaagcttgttttattcgattaggaactgcactcttacctgcgtgcctggttaatttatgcaggttaatactaaattttatccggaaatctaccattcacataaaaaaaaaa

SEQ ID NO: 100 - DNA, 1350 bp, Pinus radiata
cccttcttgaaggccatgccagtgcctttaaccttcctgcattgcgattccctgttgccattgccattttctagccccatattcccattgacagttgcagaatcacaagttaaccagatgacaatgcacagcagcagcagcaacagtaatggctctctgtggatggtggtcatggtcctaacagtaacagcacagctggttcttgctcaacagcaacagttactctcggtggattactacaactcgtcgtgcccgcaactggaaagcatcattttcaaggtaatggtgcgcaagcagagggccaacccaactacagcagcggggactctgcgcattttcttccatgactgctttgttgaagggtgcgatgcatcggtgctagtgtcgtcgatgggtgctggtcacaaggcggagcgggacgcagacatcaatctatcgttgcccggcgacggattcgacgcggtcgcccgagcaaagaccgcggtcgaagctcagtgccctggtgtcgtctcatgtgcagacattctcaccattgcaaccagagatctcattactctggtaggggggccaaagtaccaggtcaagaaggggcgcaaagatggtcttgtctcagaagcctctcgagtcgcaggcaatctcccagaagcaacgatgagcgtggacgagctaaacgccttgttcgaatccaagggcttcaatcagtcggaaatgacaacgctctcaggagctcacaccgtgggcttctcgcactgtaaggagttcatggggaggatctacaaggaacccatggatcccaccatcgatcctcaatacgctgcgggcctgcaaaaggtctgcccccagcagaacctcgatcccaacatggccgccttcaacgatgtcctttctcccaggactttcgataatgttttctatcagaatctgccaaagggtttgggcttgctggcttctgatcagatcctctacaccgatgctcggaccattggcctcgtggaaacatatgcttccgaccaaaatgctttcttccgggactttgcgcttgccatggataagctcggcagcgtgggcgttaaaacaggctacgagggagagatcagaaagtcctgcgatgctttcaataaacacagttagataattgttatataccctctttgtctgcctgagtgtaaatataaactccctggtgtacgttatttcccaaccacaacgtctgggtagcagattagagttccctgagatgggccagtgattatacttatactgtaccacctaaaatttcaaacggctcgtctttatatttttttctgagaaaattgatttgttgtagaagatccaacaataaactctggg

SEQ ID NO: 101 - DNA, 1188 bp, Pinus radiata
ccaacactcagcacacatccttatttcctaccattcggtttcgcccttatcttctgagtcagacgcggttatcttgttattccagatatgataatgaagactctactgtgcactggggtaatggctgtgttcatctgcttcattaatacaaacgctgtgaatgggcagctgaggtcaactttttatgacaaatcgtgtccgaggctgcagtccatagtgaaatcagtggtgaagcaagcggtcgctaaggagaaaagaatgggggcgtccttggtccgccttcactttcacgattgctttgtcaatgggtgcgatggttcaatcttattggatgacaacgcgacctttaccggagaaaagactgcaggcccaaacgccaattctgcgagaggattcgacgtaatagacagcattaaaactcaagtggaggcagcctgcagtggagtcgtgtcgtgtgcagacattctcaccattgctgctcgtgattctattgttcaacttcaaggcccaagatggcccgtaatgctgggaaggcgagattccacgactgcgagtttaagcgctgcaaacaacaagattccatctcccgcttccagtctcagctcactcatctcatcttttcaaggtcacggtctttctaccaaagaccttgttgcactctcaggtgctcatacaattggtcaatcgcggtgcgcctttttcagaactcgaatctacaacgaaaccaacattaacgctgccttcgctacatctgtgaagacaaactgccctagcgttggtggggataacaccctctctcccttagatgtggtaacccctaccacatttgacaacaagtaccactctaatctgaaaatacagaaaggacttctccactccgaccagcaactctttaatggaggttctacagattctcaggttacttcctacagcaccaatcagaacatcttctttagagactttgcaactgccatggtgaagatgggtaatattagccctctcactggcactaacgggcaaatccgtaaaaactgcaggaagtccaattaatctctctgaaggttgtattctccgtattttttcaggttatgttttctttgtaataagttgatttgcgatggcctattgagtcttcaaaccgaagctctaattgaaagcaataaagtacatttccctgaaaaaaaaaaa

SEQ ID NO: 102 - DNA, 1216 bp, Pinus radiata
agaagtggaagcctcttcaacttcaacttcagcttggattgcatcgtctataagaagcttagtaccctccaacactacgcacacatccccgtttctgcaactcgatttcgcttttatcttctgtgtttcatacttttcttcaaaatatgatgatgaggactctagtgtacattggggtaatggctgtgtttgtatctttcattaatataaacgctgtgaatgggcagctgagctcaacgttttatgacaaatcgtgtccgagtttgcagtcgatagtaaaatcagtggtgaagcaggcggtcgttaaggagaaaagaatgggggcgtccttggtccgccttcactttcacgattgcttcgtcaatgggtgcgatggttcaatcctattggatgacaactcaacgtttaccggagaaaagactgcaggcccaaacgccaattctgcgagaggattcgaggtaatagacagcattaaaactcaagtggagacagcctgcagtggagtcgtgtcgtgtgcagacattctcaccattgctgctcgtgactctattgttgaacttgaaggcccaacatggacggtaatgctgggaagacgagattccccgactgctagcttaagcgctgcaaataacaacattccatctcccgcatccagtctcagcacactcatttcatcttttcaagctcacggtctttctaccaaagaccttgttgcactttcaggtgctcatacaattggtcaatcacggtgcgcatttttcagaactcgaatctacaacgaatccaatattaacgctgcttttgctacgtctatgaaggcaaactgccccagcgctggtggggacaataccctgtcgccgttagatgtggccactcctaccacattcgacaacaagtattacgctaatctgaaaatacagaaaggacttctccactccgaccagcagctctttaatggaggttctacagattctcaggttactgcgtacagcaccaatcagaacagcttctttacagactttgcagctgccatggtgaagatgggaaatattagccctctcactggcactagcgggcaaatccgcaaaaactgcaggaagtccaattagtctctctgaagattgtattctccgtattccttcagcttatattttctttgtaacaaattgattttcgatcggctagttaattgacatgattgttcctaaaaaaaaaa

SEQ ID NO: 103 - DNA, 1319 bp, Pinus radiata
tcaacatgccagcaccgacaatttgcagccaagaaatgttggataatgcaatctttgactgtggagtatgctggttgaactctttctcagataagccctgtctcactaacggtcgatgcacggaatttattgctttttataatcagaagggcagagcttcggccgatacgcgctatttaactagagagtgggtttatcgggaagatattatatagtttgtttgatataaggaagcgcaatgggaacaactaggtttgggattatagagcttggggtcgtgattagtattggcttggtcttgggttcgaatctcagtgagggtaacttacaaacgggattttactcttcgagttgtcccacagcagagtccgtggtgcgctcgaccgtgcaacagagcgtccaagccgatccaactcttgcagcagggcttctgcgtttacactatcatgactgcttcgtccagggttgcgatggatcaatccttattaccgggcccaatgctgaacagacggcgccaggccattccggattgcggggctttgatgtcatagaaaatgccaagaaacagctcgaaagaatctgtcccagagtcgtttcctgtgctgacatcgttgcattggcagccagagatgccgtggcactgagtaatggacccaattatgatgtacccactggacgaagagatggaatgagatcctttgcaggggacgcttcgaacatgccagaccctacggattcagtcgatgtactcaaacgaaaatttgctgcaaagggtttatctgcatcagatcttgttgttctcaatggagcacacacgatcggaacaactgcatgtttcttcatcgaggaccgtctgtacgacttcgcaggcgctggcgacgcagacccctctatgaatcctggatacttgacggaactgagatcaatttgcccccagggcggtgatgttaatgcgagggtggctctggacaggggttccgaattccaatttgacaacgaattcctagaaaacgtgagggagggcaacggagcgctacaatctgatgcgagcatgtaccaagacagttccacccgcggctacatcgactcctattttgggctcctcggtggccttctggggccttcgtttgaatctgactttgcagatgcaattgtaaagatggggcaggtcgacgtcaaaaccggttccaatggaaagattcgtagcgtctgttcagtcctataagtaggagccgcagtcgataattgcgacatcgattttggtatttttcaaaattgtaaaaggaagtttttagtatcatatatagtaaacgattttc

SEQ ID NO: 104 - DNA, 1260 bp, Pinus radiata
ttatattcttgtttgttggatgttgatgggaataggaagccactgatagtagagtgaagtgagagcaggagaggaaatggaagcccaatacttcagtgccatgtttctccttgttattgtatcatctgcgggtgcttacgcgagtgatctgccaactccagtggaggggctatcctggacattttacaatgatagctgccccaccttgcagtcaatagtgcaatccactcttcagccgctgctggaacaaaatatcactgaagccccagggttgttgagactccttttccatgactgtttcgtgcagggatgtgacgcatcgatcttgctgaatgggacggcaagtgacccgagcgagcagcaagctactccaaacctgactctcagagccgcggcattcgagatcatcaacaaaatcaaagaagcagtggaagccaaatgcagcggagtagtttcttgcgctgacatcctggctttaacagcgtcctacgctgtatctatgggtggagggccagagtttctagtcccactgggccgcagagacagcctgacatttgccaatcaaaccgtgactttggccagtctaccaagtccgacttcaaatgtgactgtattgatgaccatcttcacagaaaagggcttcaataatttcacggaacttgtagcactctcaggtgcgcacaccttcggaatcagtcactgctcgtccttcgtgaacaggctttacccaacgcaggacaccaccctcaacgctgccttcgcacgggaacttgagcatacatgtcccacaaacacaactgtcaacaccacaaacttagacatacgcaccccaaacgtattcgacataaaatattacattgatttgcagaatggagaagcactcctcacctccgatgaagatctctacaacgacactcgaactcgacagattgttaatggctttgcgctgaaccagacctccttctttaaccaatttgcactcagtatgctgaaaatggttcagctcgatgtgctcacaggagcagaaggagaaattcgaaaaaactgcgcagttcgcaatacaaatacttcctcatattccattatagatccagcaatggggttgtcctcatcgttctcctcttgatggtctggtgtggtgtggtgagatgattagcaatcgaatccttcttccacgtactccatgtaataagttcttataaataaaggtatcctgagaataccctgcgaatagatatcgtcattctattaaaaaaaaaa

SEQ ID NO: 105 - DNA, 1164 bp, Pinus radiata
gagagtcatggcttcgtttacagcaatgcgatctctggcctttatcgccttgttgatgtgttcgaccgttgcgtacgcgcagcttagcgcaacgttttataatacatcatgtcccaaactactctcaacggtgcaggccgctgtgaagcaagcggtggccaacgagaagcgcatgggggcatcgctcctccgccttcactttcacgactgcttcgttaatggttgcgatgggtctgtgctgctggacgactcttcgactctaactggagagaagaccgccgttcccaacaacaattcggcaaggggtttcgatgtgatagacaccatcaagtctcaagtggaagcagtttgcagtggagttgtgtcgtgcgcagatattttggctattgctgctagagattctgttgtccagttgggaggcccaacatggacagtgcagctggggaggagagactccaggactgccagcctaagtggtgcaaacaacaacattccggctcctacttctaatctcagtgctctcatctcattatttcaagctcagggtctttccacgaaggacatggttgtcctatcaggtgcgcacaccataggccaagcgcggtgcacaagcttcagggcccgcatctacaacgaatccaacattaatgcagcatacgcaacttccctgaagacaaactgtccgactacaggaagcgacaacaacctgtcaccattggatcgtgttactcccactacgtttgacatcaactactactcaaatctgagaagccaaaagggacttctccactccgaccagcagctgtataacggaggttctacagtctccatggttactacctacagtaataacaagaaaaccttcttttcggagttccccacgtccatgattaatatgggaaacattaatcctctcaccggtacaagcggagagattcgcaagaactgtaggaagcctaattaacgtgtatggcagactcagtctgcgtgaagactccgacatagttccttcttttaggtttcgttgtggcctagcagcatatattatattatattgtgtgcctgtggtcctttttttaaccactgttttatcataaaaatgttcaatttcatttagaattgaatactataatttcatttataattataatattaaaaaaaaaa

SEQ ID NO: 106 - DNA, 1400 bp, Pinus radiata
gttcgtgagctaatttctgtggaatcttatcatatagtttatccctgcttgaatcatctcctgcttgcacaatctccatcgctagactccagccatatatatatatataagcattataatattttctttccatttggattgaacaatctctccatctccggataatttgctttccgtttgattgcattggattggattcaagaacagcatctctctatcagctatggctttgccttctcttcgagtgatttgggtctttgtcctcttgctcatcctggctactgtgcaggcacaactgacagccaatttttacaaggaatcgtgtcctaatctcgaaaatttggtgatagatgtggtggcccaagccgtgaggaaagaagctcgaatggctgcatctctgctgcgtctacatttccacgactgttttgtcaatgggtgtgatggttccattttgttagatgacacctcttcgtttcaaagcgagaagaatgcgggccctaatgtcaactctgcgcgaggttttgaagtcatagacgccatcaaatccacggtggagaaagcatgtcctggtgttgtatcctgcgccgatattctcacaattgttgctcgagattctgtggtcctgagcgcaggcccttattgggaagtggtactgggaaggagggactccacaagcgctagtgtagacaccgcaaatacagatattccttctccagcatttgatgtgaatcgacttgtttccacatttcaaaatcaaggcctttctcctcgagacatggttgcactttcaggcgctcacaccatcggacaggcacgctgcgtagttttcagaaacagaatctacaacgaaactacgaccatagatgggcgatatgcgagtgtgatgcatgggaggtgtcccacctctggtggaggagataacaacttgtcgcctctggattttggtagtgccaccaggtttgacaaccgatatttcacaaacgtggaagcaaagagagggctgcttcattccgatcaacaactattttcgggtggggacacttctatagcctcccttgttcactcctatgcagccaatcctccaaccttttttaatgatttccagcgagccatgataaacatgggaaacatcaaacccctcactggtaccaacggtcagatccgcaccaactgcagaatggtaaacagctaattgtagccgatggtgatccatccgcccagtctaccctgctgatacgtattatttttcgaaagattcataagatccgtgccacaatggtacgcatcatttgtaatattcgcggttatcccgccggtgtcgcagaagaaggtgaagaaaaaaaaaagagacaaaacattcccaccaccaagtacacaacaatcaaaaaaaaaaaaaaaaa

SEQ ID NO: 107 - DNA, 1344 bp, Pinus radiata
ctctttgcaaagtatttacatcatgaagacgactggaatggcaagaattatgtgtgctgcaagttttttgatatttgcatgtgcctcgacaaatgcagctggaggactgcaactgaacttctatgaccagacatgccccggagtttccaatgttgtagaagaagtagttgcaagctacatatccagagccccaactctggccgcggctcttctcagaatgcattttcatgactgttttgtcagaggttgtgatggatcggtgctcttgaattcaacaaaatcaagcaaggcagaaaaggatgcgcctccaaatctgagtctcagaggattccaagtcattgacgcagccaaagctgcagtggagaagctgtgccccagagtcgtgtcatgcgctgatattcttgcactcgttgcacgagatgctgttcatatgttgggtggaccattctggaacgttccaactggacgcagagatggagtggtgtctatcgccaacgaagctgtcgcaaaacttcctcctcccaatggaactttctcgaaactgaaatcaatatttgccagcaatggccttgatgttaaggatttggttgtgttgtcaggcggacacacaatagggatatctcactgcaactcctttagcggcaggctgtacaattttacaggtaaaggagatatggatccgtccttggataaaaattatgcagctcggctcaagataaaatgtaagctcggggacaataagacaatagtagagatggatccaggtagctttcgaacatttgacaccaattatttcgtgaatgtaaagaagaatagaggcctctttcaatccgatgctgctcttctaaccgacaacgaagcacaatcatatatcaaccagcaattgcagtacctgtcgttcttctcagatttcgcagtgtctatggagaagatgggcagaatccgcgtgctaacaggcgctgtagggcaaatccgaagacactgtgccttcgcaaattaagtggaacttcatttttttattattggagattaataagcccccggcccgtgacttcaagttttactctgtttcgattatattgagaatatttcaggttaaagatcgtgacgatagcctcagtcctgtgacttcaagttttactctgtttcgattatattgagaatatttcaggttaaagattgtcatgatgttctcaaattgttaagcgttgaatttgtactttacattgttaatgccttcactttgtactttactcttgtatcagcgagagaagatttagggatgtggattgttaagtttgtactttacagttctatcgagagagatttattttaaaaaaaaaa

SEQ ID NO: 108 - DNA, 1395 bp, Pinus radiata
ggtttttctattgagtctattttctggattactagatcatattggtttatgaatctccatgattgatacccctgcagataattgcattcatttaattctgcaaaactatggcttctaccgctgcaatgaggatcgctattacacgcgtgtggtgtgttgttttcttcgtaacttgtgtttatgggcagcttaacccacacttttacgataaaacttgtcctgaggcgttatccatagtcaattctactgtagttcaagcaatctcggaggaacgtcgaattggagcatcgttgcttcgccttcattttcacgactgtttcgttaatggttgtgatgggtctgttcttctggacgatacctcgagttttacaggcgaaaagacagcagttcccaataataattccgccagaggttttgaggtcgttgataaaataaagaagaagctggagcaggcttgcagcggtgtcgtatcatgtgctgacattttggcaattgctgctcgcgattctgttgtaacgttgggaggtcctacatggacagtgatgcttggaagaagagattccaggactgcaagtcgaagtgatgccaacaacaatattccccctcccacttctgaccttgccaagctcatctccaaatttcgagctcagggactttctaaacgggaaatggttgcactttcaggtgctcacaccattggtaaagcgcgttgcgtgaacttcagaggtcacatatacaatgattcaaacatagacaaagcgtacgccaaatctttacaagaccgctgccccaagagtggagacgacaacaaattgtcgccacttgattacaaaacgccaacaaagtttgaaaacaattactacaaaaatttggtagcagagaaaggacttttgcactccgatcaagagcttttcaatggagtgtctactgattctctggttaccgagtacagcaaaaacttggaacttttcgagagagacttcactgctgcaattatcaagatgggaaatatcacgcctctaactggttcccaaggagagatccgggagaactgcagaaagcgtaactcagatagtgccatcttcctttccagcacgcatctgatacacaatgaataattattatttcatgaaatgtggaatgctcttatgatacaaatcttattgcttgatctaggcctaatcaggtcatgaacaaatgattgggaaaatcaataacgaaatggtatggaaattatattcttatctgtacgcaaggccatggttgctaaaataaatggcatacccatgtaatcgtttctttgtttgcactatttctttgtttgcatgaggtgacttctgaccatgaatactctttttcttattagccaataagaaaatttactaaaaaaaaaaa

SEQ ID NO: 109 - DNA, 2595 bp, Pinus radiata
ctaaagtcgggagttccactaccagaccattaattcacgattcatcccacctcagcctggaaatttggtctgaatctggagcccaatactgtacaagccttggtctcttcgggaatcgtgtttggaagaagaaattgagatccggccaaagatggttgcagggtcagacctgggcgctgtgcaggccaatggaaatcaaaatggaaatggatttcatcatgtgcattctgttgatctctgcattcagaatggaccagaccctctgaactgggggcaggctgccaaggccctgcagggctcccactttgaagaagtgaagctcatggtggagtcctatttcggatccgaggaagtttccattgaaggcaaatcgctcacaatcgcggatgtgaccgcagttgccaggagaccagaggccaaggtgaaattagatgcagtgtcagcgaaggcacgggtggatgagagctctaactgggttctgcaaaacatgctcaagggcactgacacatacggtgtgacgacagggttcggagccacttcgcacagacgaacgaaccagggggccgagttgcagaaggagctcatcaggttcttgaattcgggagtcctgacagatggcaacgttctgccacaagaaacgacccgggcagccatgctggtgcgcacaaatactctgatgcaggggtactctggaatccggtgggagattctggaaacaatccagaaacttctgaacgcgggaattactccgaaattgcctctgaagggcaccattacagcctcgggcgacctggtaccgttgtcctacattgcaggtttcataacagggcgacccaattcgagagccagatgcagagacggtaaggaactcggtgctctggaagcgcttcagcaaatcggagtcgagaagccctttgagctccagcccaaggaaggactagccatcgttaacgggacctcggtcggagctgctctggcttccatcgtttgcttcgatgccaacattatctgcattgctgcagaagttctgtccgccatgttctgcgaagtgatgctcgggaaaccggagttcacagacccattgacacacaggctgaagcaccatcctgcccaaatggaagccgcggccataatggaatatgttctggatgggagctcctacatgaaaaatgccgccaaaaagcacgagatgaatcccctgcagaagccgaagcaggatcgttatgctctcagaacctcgccacagtggctcggtccccaaatcgaagtcatcagatccgctacccacatgatccagcgagagattaactctgtcaatgacaaccctgtaattgacgttgctcgagacaaagcactgcacggcgggaacttccaggggaccccaatcggtgtctccatggacaacctgcgcctcgctctcgccgcaatcgggaagctaatgttcgcccaattctcggagctcgtcaacgattactacaacggtggcctgccttcgaatctcagcggtggccccaacccgagcctcgactacggcttcaagggcgccgagatagccatggcttcctacacatcggagctccagtacctcgccagccctgtcaccacccacgtccagagcgccgagcagcacaaccaagatgtcaattctctgggcctcatctcagcccgcaaatcagccgaggcaatcgacatactcaatctcatggtctccacgtatttgctcgcgctctgtcaggccgcggatctgcgacacctggaagaaaacatgctgagcaccgtgaagagcgtggtctcccacgtggccaagaaaatgctgagcacgcacaacggggagcttctcaccgcggggcgcttctgcgaaaaagacctcctccaggccgtcgagaacctccacgtcttcgcctacgtggacgacccctgcaacgagaactacccattgatgcaacagctcagacaagttctcgttgcccacgctctgaccgagactgcccaaattcaaactcaaacccagtcctccattttcaacaagattcccgccttcgagaaagaattgaaagaccaaatggaagcagaaatagggcgcgctcgccaggactactacgaaaggggggtcgcgggttcgattcccaacagaatccaggaatgcagatcctttcctctctacgacttcgcgagatcgcagctcggcacccagctcctttccggcgatagggtaacttctccgggcgaatatattgaaaaggtttacaccggaatccgtgaaggcaagattatttcgcccctcttcaagtgcctggacggatggtctggaactcccgggccatttcacagttaaattcctgaaccatcatcctgttatatatagtttacaaattgaataaatggagtaatatattaagcattggaaacggcaggaggacctgcagcacgttttgcatagaatgtagcatgaacacagctcgcgcctggccagcatttaatgctgtgtatagtcatttttgaattcaaaatatgaattttgtgtggattacaatttggcaaaccgattttcgccggtatttggaaatattatataatttttaattaaaaaaaaaa

SEQ ID NO: 110 - DNA, 2366 bp, Pinus radiata
ctttaaggtgtcttattgagaagtttgagtgagccatttctgtaagctttgaattagtctgcaatggagtactcccacgtcaaaggaaaaggttgtgctactgcttttacttctcacgttaaggacattgtccttctgatcaataccttcaacgaaatcaagaacatcaatgtcgatggttctcgcatcaccgttgcccatgttacagccctagggcgaaggccccaagtgaaagtgacacttgataatcatggcgggaattgcagagaacgggttgagaggtgttctttttgggtgcaagagaaagccaaggaaggcgctgatatctatggcgtgaccactggattcggtgcttgttcaagcaagagaaccaaccaactgagcgagttgcaagaagccctaattcggtgtttgctagctggagcattcacctgcccttcttcgtcgccgggggagctctcccccatcacgactcgatgcgccatgtttctgagaatgaatagcttcatctatggctgctccgggattcgatgggagatcatggaagcgctacagcaacttatcaatactcagatcacgcccaaatgccccttgcgaggctctgtgagcgcttcaggtgacctaattcccttggcctacatagcaggtctgctaattgggaatccccaagtcaaggctcgaattgggggtcatggtgaagaacaagaagtggccgcaccggaggctctggtgaaagcaggcctgcagcccttcaagctccaggccaaagaaggcttggctcttgtcaatggcacttcgtttgccactgccctcgctgccaccgtcatgtatgatgccaacgttctgctcttgctcgtggaaatgctctgtggaatgttctgcgaagtcatcttcgggcgtgaagaattcacgcatccgctgatccacgagttgaagccgcatccagggcagatacaatccgcggcacttcttgaatggcttctcagaaacagccccttccaggagctttcaagagagtattacagcatcaattctctgaaaaagcccaaacaggaccgctatgctctacgttcgagtccccagtggctggcccctctggtgcagacaataagagaagccactgccacaattgagacagagatcaactctgccaacgacaatcccatcattgaccatgtcaacggcaaggccctccatggcgccaatttccagggcagtgcagtgggattctatatggattatgctcgtgtagctctggctggactgggtaagctcatctttgcacagttcacagagctaatgattgaattctacagcaatgggctaccgggcaaccttgccctgggtcctgacctgagcttggactatggcttcaagggagtcgacatagccatggctgcttacagttccgagcttcaattcctggctaacccagtgactacccacgttcacagtgccgagcagcacaaccaggacatcaattctctggccctcatatctgctaggaagactgaagaagctctggatatcttaaaattaatgctggcatcttacttatcagctctctgccaggcaatagatctcagacaactagaacaaatacttgtaaaagctgtgtcaggagtcatttcaagtgtttcagatgcatgtcatctccctgaatccattaaagaagggcttattaacgtcgccaggggtattccagtgtacacatatttagaatccccttgcgacccttccttcccacttgtctctgccctcaaacaaacgtttcttgactccattcttgtattccacgaccttcaaattgtagagcagatacaagagttcgaatcccacctcaagcaacgactagaagaggagttaacagcaaccaggctgtcatacgagcagcgcaatcgcattcccatgcaggaaggctcctgtttcagaacattaatccatgggtctaaattctttgctctgtacgcgtttatccgggacgagctcaacaccaaaatgatgactccgaggacagaccagacgccccagcaggatatccagaaggtgttcgatgcaattgtggatggccgaatcactgtacctctgcttcagtgcctcaacggattcataaattgattgatatcatcatcaatttatgaaagaacacgcccacgctaagaaacttgcatggttcgttgcagtattttcatctctataaatgcaccagcctcactgcattttatatacattcatctctatatatgcacaatgctcactgcattatatatttccacctccatatatgcacgtagaccctgcttgtgtaataatattgctggtcatcgttttgccataatatcaatattattgcaatcaaaaaaaaa

SEQ ID NO: 111 - DNA, 2741 bp, Pinus radiata
  modified_base (2254): a, t, c, g, other or unknown
gctacgtcgctccttcctcgtttcaaagctgactgggtcgcacagtgccaggctcgacctcaccgtctgtataagtaccctgcatttatgcattctcttcacccgctgcctgtaacctccttccagatattgcagagcctgggcactagagatttcctagtgacatctttattatttatcaatttttcagtaggcagagatcatgtcgtcatctgtgggagaagagagcagcagaatggagaacataaacggatcaatgaggtccatggaactgtgccgaccgccaacgttgcctctgccggggcctttgacgggaagaaccccgaccacgtcacctttcctacacactggaagaaggcggcggaggcgatgcagtgcagccattacgaggaagtgaggaagatgattaagcaatttaacacaacacgcaaagtggtgctgagagggactactctcacagttgcagaggtgactgccgtgacgcgcagggtggaggtgagagtggagctagacgaggcgagcgccaaggagagagtggagaggagctaccagtgggtggccaaaaacgttgccaggggaaccgacacctacggcgttacaactggctttggagccacctcccaccgtagaaccgacaaggcagcggatctccagaaggagttgatccgcttcctcaatgcgggagtcgtggggaaggaacgtttgtgcttgccggcggagtacacgaaggcggccatgctcgtccggacaaacaccttgatgcagggctactcaggcatccgatgggaaattcttgacgctctgagaaagctcatggacgtaaacatcacacccaagttacctctcaggggaacaatcaccgcctcaggcgatctggttcccctctcctacattgccggattgctcaccgctcgccccaactcaaaagccctctcgcccgacggccacttgttggacgccatggaagctctccggaaagccgggattctggaaccgtttaaactgcagcccaaggaaggactggctctcgtcaacggcacagcggtgggatccgccgtggccgcgtccgtctgttttgacgccaacgtgctgggcgtgctggctgagattctgtctgcgctcttctgcgaggtgatgcaagggaaaccggagttcgtagatccgttaacccaccagttgaagcaccacccagggcagatcgaagccgcggccgtcatggagttcctcctcgacggtagcgactacgtgaaagaagcagcgcggcttcacgagaaagacccgttgagcaaaccgaaacaagaccgctacgctctgcgaacatcgccacagtggttggggcctccgatcgaagtcatccgcgctgctactcactccatcgagcgggagatcaattccgtcaacgacaatccgttaatcgatgtctccagggacatggctctccacggcggcaacttccagggaacacccatcggagtttccatggacaacatgcgaatctctttggcagccgtcgggaagctcctcttcgctcaattctcagagctcgtctgcgactactacaacaacggtttgccttccaatctcagcggtggccccaatcctagtttggactatggtttcaagggcgccgagatcgccatggccgcttacacatcggagctccagtacctggccaaccccgtcacgactcacgtccagagcgccgaacaacacaaccaggatgtcaattccctcggcttgatctccgccagaaagactgccgaggccgttgagattttaaagctgatgttcgctacatatctggtggccttatgccaggcgatcgatctccggcacctggaagaaaacatgcgatccgttgtgaagcacgtagtcttgcaggccggaagaaagacactgtgcactgcagaagacggaagccttcacgacaccggattttgcgagaaggagctcctgcaagtcatcgatcatcagcccgttttctcgtacatcgacgatcccacaaatccatcatacgcgcttatgctccaactcagagaagtgcttgtagatgaagctctcaaatcatcttgcccagacgggaatgccgaatccgatcacaatttgcagcccgctgagagcgctggagctgctggaatattacccaattgggtgtttagcaggatccccatatttcaagaggagttgaaggcccgtttagaggaagaggttccgaaggctagggaacgattcgataatggggacttcccaattngcaaacagaataaacaagtgcaggacatatcccatttacagattcgtgagatcagagttgggaaccgatttgctaacagggcccaagtggagaagcccggcgaagatatagaaaaggtatttgagggcatttgccaagggaaaattggagacgtgatcctcaaatgtctggacgcttggggtgggtgcgctggaccattcactccacgtgcatatcctgcgtctcctgcagcgttcaatgcctcatattgggcatggtttgatagcaccaaatcaccctctgcaacgagcggcagaggtttctggagcgcccaacaacaacaagttctttgatttaactgactcttaagcattcctaaacagcttgttcttagcaataatgaatctttcatcttcgttactttgtaaaagatggggttccaacaaaatagaagaaatattttcgatccacaaaaaaaaaaaaattttctgtgaaaaaaaaaaaaaaa

SEQ ID NO: 112 - DNA, 2394 bp, Pinus radiata
ttcggctctcattctgaggttcatctggctgaagtttgaactgtgctcgaattctgaggttcatcgtgcagaagtttgattcgtaaattatttgtttgtttaattatagtgcacatggcgcctcaggaattcacaggcgaagtgaaattctgtgcgggaaatggcggtacggcgtctttgaacgatccgctgaattgggcagccgcagcggagtccatgaagggatctcacttcgaggaagttaaacgaatgtgggaggagtttcgttctccagttgtgaggctccagggatccggtctcacgattgcccaggtggcagccgtggccaggagaatgggatccgtgagagtcgaacttgagaccggcgcgaaggcgtgggtagatgagagcagtaattgggtgatggacagtatggcgaacgggacggatagctatggcgttacgacggggttcggcgcaacgtcgcataggcgcacccgccagggtgaggcgctgcagaaggagctgatccggttcctcaatgcggggatattcgggggctgcggggattccaactcgctacctcgcgatacgactagggcggcgatgctggtgcgtgcgaatacgttgctgcaaggctactcggggatccgctgggggattctggaagccatgagcggcttattgaatgccggaattacgcccaggctgccgttgcgaggtacgataacggcgtccggggacctggtgccgttgtcgtacatagcgggtctgttgacggggcggtcgaatgcgagagccgtgacggccgacgggacggagctcggggcggcagaggcgctggcggcagccggggtggagaatgggccatttgagctacggcctaaggaaggattggcgcttgtcaacggtacagccgtgggatcggctctggcggccacggtgctcttcgatgctaacgtggtcgtgcttctgtcggaggtgctgtcggccttgttctgcgaagtcatgcaagggaatccggagttcacagatcatctcacacaccggctcaagcaccacccgggtcagatcgaggcggcagcgatcatggagcacctcctagatggcagctcatacatgaaggctgccgccgcgaagcaccaagaggccgacgcattgtcaaagcccaagcaggaccgctacgctctgcgcaccgccccgcagtggctcggcccgcaggtggaggtgatacgtgcctcgactcacatggtgcagcgcgagatcaactccgtcaacgacaaccccctcatcgacgccgcccgcaacaaggcgctccacggcggcaatttccaggggacacctgtcggcgtcgctatggataacgcacgcctggctctcgctgcagttggtaagctcatgtttgcacagatgtcggagctcgtcaatgatttctacaacaacggtctcccatcgaatcttagcggtggacccgaccccagcctggattacggtttcaagggtgccgagatcgccatggccgcttatacctcagagcttcaattccttgccaatccagtgacgacacacgtccagagcgctgagcaacacaaccaagacgtcaactccctcggcctaatctccgcccgcatgacggcccaggccgtcgatattttgaagctcatgacttcgacgtacctcgtggcgctctgccaggccatcgacctacgacacctggaagagaatctacttgccgcagtccgacaatccgtaggacaggcctgcaagaaaacccttgttgtgggtccccgaggagagctgctaccttctcgcttttgcgagaaggacctcctcaaggccatcgatcgggaaccggtgttctcctacattgacaacccctgcagcgctacctccgttctgaccacgaagctccgccaggtgctcttcgaacacgcgatcgaaaagacaaccaataacgacgcttctatccttactagaatcccggcattcgaagaggagctcaaagcgcgcatcgttgccgaggttcaggagacgaggggcgccttcgaaaaaggcgctgcccttgttcccaacagaatcaaggactgccgctcctatccgctgtatgagttcgtgagagtggagctggggacttcgttactggtgggcaccaatagccgctctcccggcgaggacttcgacaaggtgttcgttgctatcaacgaaggcaaggcggtggaaccgttgttcaagtgccttgagcgatggaacggcgcccccattcccatttgaatttaattaaaagctaataacgcaatgttgtttttggctgcgtgaggccacccttatttctaaggaaagtatgttgtatttatatcctgtaaacaaattaaattaaaaagattaattaaaatggtttcaaatttaaaaaaaaaa

SEQ ID NO: 113 - DNA, 2153 bp, Pinus radiata
gtgcaaatggcgtcacaggaattcacaggcttaatgaacttgtgcgcaggaaatgatcggctgaattgggcatccgtagcggagtccatgaagggatctcactttgaggaagtgaaacgaatggtggaggagtttcgtgccccggtcgtgaggctccagggatccggtctcacaattgctcaggtggcagccgtggcgaggagattgggatccgtgagagtcgaactcgacaccggcgcgagggcgagggtagaggagagtagtaattgggtgatggacagtatggccaacgggaaggctatctatggcgttacgacggggttcggtgcatcgtcacataggcgtacaagccacgctgaggcgctgcagaaggagatggcccggttcctgaatgcggggatatttgggggctgcggggattcgaacacgctacctcgcgatgcgacgagggcaacgatgctagtgcggacgaatacgttgctacagggctactcggggatccgctgggggattctggaggccatgaccggtttgttgaatgctggaattacgcccaggctgccgttgcgaggttcgataacggcctccggggacctcgtgccgctgtcgtacatagcgggtctgttgattgggcggccgaatgcgagagcggtgatggcggacgggacggaggtgggagcagcggaggcgctggctgcagctggggtggggaacgggccatttgttctacggcctaaggaaggggtggcgcttgtcaacgcgacggccgtcggttcggctctggcagccacggttctgttcgatgccaacgtggtcgtccttctgtcggaggtgctgtcggcgttgttctgtgaagtcatgcaaggggatccggggttcactaatcatctcatacaccggctcaaagaccaccccggtcagatcgaagcggcagcgatcatggagcacctcctagatggaagctcatacatgaaggctgccgccacgaagaacaaggaggccgacccattgtcaaagccgaagaaggaccgctacgctctgtacacctccccacagtggctcggcccgcaagtggaggtaatacgtgcctcgactcacatggtgcagcgcgagatcaactccgtcaacgacaaccccatcatcgacgccgccggcaacaaggcgctcaacggcggtaatttccaggggacacctgtcggagtcgccatggacaacgtacgcctagctctcgctgccgtaggcaagctcatcttcgcccagatgtcggagctcgtcaatgacttttacaataaaggtctcccatcgaatctcagcggtgggcccgaccccagcctggactacggtttcaagggtgccgaggtagccatggcctcgtatacctcagagctccaattccttgccaatccggtgaccacacacgttcagagcgcagagcaacacaaccaggacgtcaactccctcggtctcatctccgcccgcatgacggcccaggccgtcgagattttgaagctcatgacttcgacgtacctcgtggcgctatgccaggccatcgacctacgacacctggaagagaatctacatgccgcagtccgacaagctgtcggagaagcctgcaagaagaccctcgttgtgggaccccgaggagagctcctcctcctaaaggccgtcgaccgggagccggtgttctcctacatcgacaacccctgcagcgctacctccgttctgaccacggtgctccgccaggtgctcttcgaacacgcgctcgaaaagacaaccgacaacgacggttcgatccttaccagagtccctgcattcgaagaggagctcaaagcccgcattgttgcagacgttcatgagacgagggccgcctgcgaaaagggaaccgccctcgttcccaacagaatcaaagactgccgctcctatccgctgtacgagttcgtgagagtggagttggggacttcgttgctggtgggcaccgatagccgctctcccggcgaggacttcgacaaggtgttcgttgcaatcaatgaaggcaaggcggtggcaccgttgttcaagtgccttgagggatggaacggcgcccccattcccatttgaattttgaattaaactaaattaaataaatgaaatgaaatgatgtattaaaaaaaaaa

SEQ ID NO: 114 - DNA, 2528 bp, Pinus radiata
acagcaccatgatggttagttataaagccatggtgctgtccgtgagaattccatggcgtgcgttcaggattctgaattttgcgtcagtctgtaacctttgagctagtctgcaatggagtactcccaattaaatagtaacagttgtataactggccggtatcgttcttgtcacgtggaggacatcatccttctgatcaagacgttcaacgaaatcaactgcatcaacgtcgatggctcccgcatcaccgttgcccatgtcacagccctgggccggagaccccaagtgaaagtgacacttgataatcatggcgggaattgcagagaacgggttgagaggtgttcgttgtgggtgcaagagaaagcgaaaggaggagctgatatctatggcgtgaccactggattcggcgcctgttcaagcaagaggaccaaccaactgagcgagttgcaagaagccctaattcgatgtctgcaagctggagtattcaccggcccttcttcgtcaccgggggagctctcccccatcaccgctcgatgcgccatgtttctgagaatgagtagcttcatctatggctgctctgggattcgatgggagatcatggaagcgctacagcaacttatcaattctcatatcacgcccaaatgccccttgcgaggctctgtaagcgcttcaggtgacctaattcccttggcctacatagcaggtctgctaattgggaatccccaggtcaaagctcgaattggggctcatggtgaagaacaagaagtgcctgcaccagaggctctgatgaaagcaggcctgcagcccttcaagctccaggccaaagagggcttggctcttgtcaatggcacttccttcgctactgccctcgctgcaaccgtcatgtatgatgccaatgttctgctcttgctcgtggaaatgctctgtggaatgttctgtgaagtcatctttgggcgggaagaattcgcgcatccattgatccacgagatgaagccgcacccaggccagagagagtccgcggcacttcttgaatggcttcttagagacagccccttccaggagctttcaagagaatattacagcatcaattctctgaaaaagcccaaacaggaccgctatgctctgcgttcgagtccccagtggctggcccctctggtgcagaccataagagaagccacggccacaattgagacagagatcaactctgccaacgacaatcccatcatcgaccctgtcaacggcaaggccctccatggcgccaatttccagggcagcgcagtgggattctacatggattatgttcgtgtagctctggctggactggggaaactaatctttgcacagttcacagagctcatgatcgaattctacagcaatgggctcccgggcaacctttccctaggtcctgacctgagcttggactatggcttcaagggaatcgacatagccatggctgcttacagttcggagcttcaattcctggctaacccagtcactacccacgttcacagcgccgagcagcacaaccaggacatcaattctctggccctcatatgtgccaggaagactgaagaagctctggatatcttaaaacttatgctggcatcgcacttatacgctctctgccaggcaatagatctgcgacaactggaacaaattcttctaaatattgtgttaggaatcatctcaagcgtttcagacgaatgccatcttcagcaatccattaaagaacagcttattagcgttgccaggggtattccagtgtacacatatttagaatccccctgcaacccttccctcccacttgtctctgccctcaaacaaacatttcttgatgccattgttacattacacgatattcaaattgtagagcagataacagagttcgaatcccacctcaagcagcgccttgaagaggagataacagcaatcgtgctttcatacgaggagcgcaccaacagtcacatgctggaaggctcctgttgcagaacgttaatccatggctctaaattctttcctctgtatgcatttatccgggaggaactcaacgcgataatgatgactccgaggacagaccacacaccccaaaagggcacccagaaggtatttgatgcaattgttgatggccgaatcactgcacctctgcttgagtgcctcaacggattcatgaattgattgatatcatcaaatttatgaagtctgcactcagaaatttacagcgttctccagcatatgtagacatgtctatatatacacacagttcttattgaaaagtagatatttttagatatagatataggagtgtctaacgaggccaggaattctaacgaggccagttctctgtctagactgttaaaagtggtttgaatttaggtaaaagaatttcaaatttttttgtacaagtagtgtttgaatcgtattttttatggtggaaatggattcagcatcatcaaaactgtctaatatacttaaaattttgaagtttaacaattataacttggatttacaaaaatcctcaccaaaaaaaaaa

SEQ ID NO: 115 - DNA, 2016 bp, Eucalyptus grandis
ctctttccctccacccaaatctctacacatcatcatcatcatcatcatcatctcctcccctcccttttctccatcgctgtaatcatcatcgtcaccgccgctgcagccaccatgatctccgtggcgccctcccccgaaaccgccccccagaacccctccgaagtccctcagggggagaagcgggaggcccccgccgcatgcaccatcttccgatcgaagctcccggacatccccatccccaaccacctctccctccattcctactgcttcgagcacgtcccccagttccccgaccgcccctgcctcatctccgactccaccggcaagagcttctccttctccgacgccctgctcctctcccgcaaggtcgcggccggactccacaacctcggcatccgccggggcgacgtcgtcatgaccctcctccagaactgccccgagttcgccttctccttcatgggcgcctccatgatcggcgccgtcaccaccaccgccaaccccttctacactccctccgagatcttcaagcagttcgcggcctcccgcaccaagctcgtcatcactcagtccctctacgtcgacaagctccgcgaccacgccgacggcaacggccccaccctcggcaaggacttcgtcgtcgtcaccgtggacgacccgccggagggatgcgtccacttctcggtccttggcgaggccaacgaggaagaggcccccgaggtggcgatccacccggacgacccggtggcgctgccgttctcgtcggggacgacggggctgcccaagggggtgatcctgacgcaccgcaacctgatcaccagcatagcgcagcaagtggacggcgagaacccgaacctccacctgagggcggaggacgtgatgctgtgcgtgttgccgctgttccacatctactccctcaacagcgtgctgctctgctcgctccgcgccggggcgggagtgctgctgatgcacaagttcgagatagggacgttgcttcagctgatcgagcgccaccgggtgtcggtggccgcggtggtgccacctctggtgctggccctggccaagaaccccctggtcgagaagttcgacctctcctccatccgcatggtgctgtcaggggcggcgccgctgggcaaggagctcgagctcgccctccagacccgcctccccggagccatcttgggccagggatatggaatgacggaagcgggaccggtgctttctatgtgcttggggttcgccaagcaacccttcccaaccaaatcgggttcgtgcgggacggttgttcggaatgcagagctcaaagtcatcgaccccgagaccggttcctcccttggctacaaccagcccggcgagatatgcattcgtggccagcaaattatgaaaggatacctgaacgaccccgaggcgacttcgatcaccattgacgcggatggctggcttcacaccggtgacataggctatgtcgatgatgatgatgagatcttcattgtggacagagtgaaggaaataatcaaattcaaggggttccaggtgccaccagccgagcttgaagcgcttctagtaagccacccatccattgcggatgcagctgtcgtcccgcaaaaggatgaagtcgccggtgaagtcccggttgcatttgtggtgagatcgaatggctttgaactgacggaagaagcagttaaggagttcatagccaaacaggtggttttctataagaagcttcacaaggtccacttcgtgcatgcaatcccgaagtctccgtccgggaagatactgaggaaagatctcagggccaagttagctacggcggcccccatttcttaaattcgttaggttgtgatttcggggtttggtgagcattttactggtggggggttctcccattgtttttcttcttctttctttaccgtctttccagttataattgcataaacagaagtggggagagcaacaagtggtgagcaatttgatcctcttgaagattcaataatattatcaatccttccaaaaaaaaaa

SEQ ID NO: 116 - DNA, 1264 bp, Eucalyptus grandis
gcaccgagtccagtactcgttcactctctcccccgagccacaggagacgagaccagcgtgtgtgaactccacggttcaggtgccgagaacggagaagatgagcggagcagggaaggtggtgggtgtgaccggagggtcgggttacatagcttcttggctggtcaagctcttgctccaccgtggctacactgttcgagccacaatccgagacccaaccgacccaaagaagacaggacacctcctggcactggagggggctaaggagaggctgcatttattcaaagcggaattgcagcaagaagggtcctttgactccgtagtcgacggatgcgaatgtgtttttcacattgcattcccctatctgccctcagctgctgacccccaggctgaaataattgatcctgccgtaaagggcaccctcaatgttctaagatcatgcgccaaagcctcttctatcaagagagtggttgtgacgtcctctatggccacagttgcatttagtgcaaaacctgtgacttcgggcattgtcattgatgagacttgggattcagatccagaattttgccagaaatccaagctctggtatatcctttcaaaaaccttcgcagagaaggcagcttgcgaatttgccaaagagaatggaattgaccttgtgatcataaacccaggacatgtgttcggtcccttcttgcagcccactgttaatttctccgtggggttaatactgaacctcatcaatggagctcaaacatttccaaatacatgctatatatttgtcgatgtcagagacgtcgcacacgcacacattctagcttttgaaaatcattcagctcacggaagatattgcctagtagccaaaactgtgcactgccatgatgttttgcagattctgcgcaatctctaccccactttgcacctccctaagaaatgcgaagatgagaagcctttctcttcgaaggatgagatatcaacaaagaaggcagaagctctgggtgtcgacttcactccattggaggtgagtctgagagataccgtcgaatgcctcaaggagaagggattcatctctgtctaggcagttgcttagaacagcatatcacaagcttgctaataatgacttgtggacctgtggtctgtcctcagccttttagctcctaaatcgtacgattgttctgaataatgtatcattacccactttcagagattactctgccagtttttcccagctaatcttaaatttattaatggttggtttctaaaaaaaaaa

SEQ ID NO: 117 - DNA, 1264 bp, Eucalyptus grandis; identical to SEQ ID NO: 116

SEQ ID NO: 118 - DNA, 1575 bp, Eucalyptus grandis
caccatcccacccgccgtcgtttcgacatccatcgatcgatcctctccctctctctctctatctctagaaatggcgcccgcttctctccacgagcccccgaacgccgtctgcgtcatggacgcctccggccgcctcggctcccgcctcgtccgccgcctcctccgccgcggctactccgtccacgccgccgtccagagcgaaggcgagatcgatcggctgaaggagctgtcgtcctcgtcgcccgacgacgcggagaggctgaagatcttccgctccgatccgttcgactaccagagcatcgtcgacgcgctgcgggggtgctccggcctgttctacgccttcgagccgcctcaggaccagccgagctacgacgagtacatgaccgaagtggaagtaagggcagcacacaacgtgctggaggcgtgcgcccagacagacaccatcgacaaggtggtcttcacttcctccgtgaccgcggtggtctggacagatgaccggaaatcgcaggaatcggatttcgacgagagacattggagcaacgtcaacctgtgccgcaaatacaagctgtggcacgcgctgtcgaagacgctggcggagaaagcggcgtgggccctggcgatggaccgaggcgtgaacatggtgtccgtgaacggagggctgctgatggggccggacctgtccatcgcccacccgtacctgaagggagcggccgagatgtacgaggacggggtgctcgtgaccgtcgacgtcgacttcctggtcgacgcccacttgtgcgttttcgaggacgtctcctcctacggccgctacctgtgcttcaaccacatcgtcaaccgccccgaggacgccctcaagctcgcccagatgctcaccccctcggctccttcgatgcctcaaagctacgatcaggagctgaagatcatcgagcagaggatcggcaacaagaagctcaataaactcatggtggatttcgagagaggagtccaggtggactgatccgtcaatcatctcagtctcaagcgccgcagcttggggaaagagagattaaaaaagaagaagaggggaatagattctcgattatcgtgtttatataaagatttctattaggttcatcgctcctggaagaaacatctctctcgcgctcatcatgggacggtcgacacgcgggaagaatataggggtataacaccagctcctaccacgctcctcgaccatctgataatgaacgagaaatttatattttttttcgttctcatcggtgggggagcctaaggataatcttttatatagttggaggggtttctagaataatagggagaaacgataaatgcttagtttggtgctgcccgcacttgggcacattcgaggaatgagaccctgtctgtctcaaggtgagaaagagtcaacgacggaactaaggcgcacttaatgttacagtggaaggcggcgagaaggagacgaagatcgtcgacttttttccaggttgtaaattgtaattgttttccagctagtcatgcccattgcctagtcgacggccatgtaaataaatgctggatttcttcttaaaaaaaaaa

SEQ ID NO: 119 - DNA, 1497 bp, Eucalyptus grandis
caagcgtccacaagtcctgccttccctgtgcatgcccgacaagcggccaccctcctctcctcctcctcctccctcccctctccaaccaccgcccctcaaacgtcagcacctccctcctcctcctcctcctgaacccctctcccccctcgccggcaatcccaccatgcccgtcgacgccctccccggttccggccagaccgtctgcgtcaccggcgccggcggcttcatcgcctcctggattgtcaagcttctcctcgagcgaggctacaccgtgcgaggaaccgtcaggaacccagacgacccgaagaatgggcatctgagagagctggaaggagccagcgagaggctgacgctgtacaagggtgatctgatggactacgggagcttggaaaaagccatcatggggtgcgacggcgtcgtccacaccgcctctccggtcaccgacgatcctgagcaaatggtggagccagcggtgatcgggacgaaaaatgtgatcgtcgcagcggcggaggccaaggtccggcgggttgtgttcacctcctccatcggtgcagtcaccatggaccccaaccggggtccggacgttgtggtggacgagtcttgttggagcgacctcgaattttgcaagagcactaagaactggtattgctacggcaaggcagtggcggagaaggccgcttgcgcagaggcaaaggagagaggggttgacctcgtggtgattaaccccgtgctcgtgcttggaccgctccttcagtcgacgatcaatgcgagcatcatccacatcctcaagtacttgactggctcggccaagacctacgccaactcggtccaggcatacgtgcacgtcaaggacgtcgcgcttgcccacgtccttgtcttggagaccccatccgcctcaggccgctatttgtgcgccgagagcgtcctccaccgtggcgatgtggtggaaatccttgccaagttcttccctgagtataacgtaccgaccaagtgctctgatgaggtgaacccaagagtaaaaccatacaagttctccaaccagaagctgaaagacttggggctcgagttcaccccggtgaagcagtgcctgtacgaaactgtcaagagcttgcaggagaaaggccacctacccgtccctcccccgccggaagattcggtgcgtattcagggatgatcttagatccatcacggtgcgcatttgtaatccggagaaatgagagaaacatgtgggaatttgtttgtacttttctaagtcaaacctggagataccaaccctgagttctgcattggaatggaagttgtcaattgatcaatcgtcgcaagttatcgttggcagaaacggaatgtcagttaccatcccgagcagcatattcacacattagattcttgtctttcctgtatgtcgtgtaatgggatatcgcagatataattatatctctaaagctaatttccgtgttgaaggttagtctattgtgttcttccctactgtccagattt

SEQ ID NO: 120 - DNA, 1497 bp, Eucalyptus grandis; identical to SEQ ID NO: 119

SEQ ID NO: 121 - DNA, 1566 bp, Eucalyptus grandis
gcaagcgtccacaagtcctgccttccctgtgcatgcccgacaagcggccaccctcctctcctcctcctcctccctcccctctccaaccaccgcccctcaaacgtcagcacctccctcctcctcctcctcctgaacccctctcccccctcgccggcaatcccaccatgcccgtcgacgccctccccggttccggccagaccgtctgcgtcaccggcgccggcggcttcatcgcctcctggattgtcaagcttctcctcgagcgaggctacaccgtgcgaggaaccgtcaggaacccagacgacccgaagaatgggcatctgagagagctggaaggagccagcgagaggctgacgctgtacaagggtgatctgatggactacgggagcttggaaaaagccatcatggggtgcgacggcgtcgtccacaccgcctctccggtcaccgacgatcctgagcaaatggtggagccagcggtgatcgggacgaaaaatgtgatcgtcgcagcggcggaggccaaggtccggcgggttgtgttcacctcctccatcggtgcagtcaccatggaccccaaccggggtccggacgttgtggtggacgagtcttgttggagcgacctcgaattttgcaagagcactaagaactggtattgctacggcaaggcagtggcggagaaggccgcttgcgcagaggcaaaggagagaggggttgacctcgtggtgattaaccccgtgctcgtgcttggaccgctccttcagtcgacgatcaatgcgagcatcatccacatcctcaagtacttgactggctcggccaagacctacgccaactcggtccaggcatacgtgcacgtcaaggacgtcgcgcttgcccacgtccttgtcttggagaccccatccgcctcaggccgctatttgtgcgccgagagcgtcctccaccgtggcgatgtggtggaaatccttgccaagttcttccctgagtataacgtaccgaccaagtgctctgatgaggtgaacccaagagtaaaaccatacaagttctccaaccagaagctgaaagacttggggctcgagttcaccccggtgaagcagtgcctgtacgaaactgtcaagagcttgcaggagaaaggccacctacccgtccctcccccgccggaagattcggtgcgtattcagggatgatcttagatccatcacggtgcgcatttgtaatccggagaaatgagagaaacatgtgggaatttgtttgtacttttctaagtcaaacctggagataccaaccctgagttctgcattggaatggaagttgtcaattgatcaatcgtcgcaagttatcgttggcagaaacggaatgtcagttaccatcccgagcagcatattcacacattagattcttgtctttcctgtatgtcgtgtaatgggatatcgcagatataattatatctctaaagctaatttccgtgttgaaggttagtctattgtgttcttccctactgtccagattttcttcctcagatctagaccttgaaatacatgcgatttgtggcctcgatttgtctgttcaaaaaaaaaa

SEQ ID NO: 122 - DNA, 1232 bp, Eucalyptus grandis
ggagagagagaggcacctcctcgaaacgaagaagaagaaggacgaaggacgaaggagacgaaggcgagaatgagcgcggcgggcggtgccgggaaggtcgtgtgcgtgaccggggcgtccggttacatcgcctcgtggctcgttaagctcctcctgcagcgcggctacaccgtcaaggcctccgtccgcgatccgaatgatccaaaaaagactgaacatttgcttggacttgatggagcgaaagatagacttcaactgttcaaagcaaacctgctggaagagggttcatttgatcctattgttgagggttgtgcaggcgtttttcacactgcctctcccttttatcatgatgtcaaggatccgcaggcagaattacttgatccagctgtgaagggaacactcaatgtcctgaagtcatgttccaaagcaccttctctgcagcgtgtggtcttgacatcatctatggctgcagttgcatacaatagacaaccgcggacacctgaagttgtggtggatgaaagttggttttctgatccagacttgtgcaggcaaaccaatgcgtggtatgtgctttccaagactttggctgaggacgctgcctggaaatttgtgaaagaaaagggcattgacatggttacaattaacccagctatggtgattggtcctcttttgcagccaacacttaacacaagtgctgcggcgatcggaaatttgataaatgctgcaccaacttttccaaatgcaagttttggatgggtcaatgtcaaagatgttgcaaatgctcatatactggcatttgaggtcccatcagccagcggaagatattgtttagttgagagaattgcacactactccgagatcgtgaggatcttacgtgagctttacccttctgcccagcttccagaaaagtccgcggacgacaagcctttcgtgccgatctatcaggtgtccaaggagaaagtgaaaagcttggggatcaactacattcctctggagcagaatttgaaggagactgttgaaagcctgaaggagaagggatttgttaagttctgatagaaaattttcccaattcagaaatgtaatagggaggcttatcaccctactgcctgttcgttttcatgaagtgtgtttgcacatgaacattggtgaaggcaggaaaccacagactttcctgcttcctctgtactcgtcttcataataaagcgaggagtgccgtcgctgtaaaaaaaaaa

SEQ ID NO: 123 - DNA, 3533 bp, Eucalyptus grandis
atttaaaggagccacgatccggccggaagtcccagtgcaacacgtcgccgaaacccaggtcgatccgccggcgaattccgcgatgtcgaagcagggagaggccgtgtgcgtcaccggcggcagcggctgcatcggctcctggctcgtccgcctcctcctcgagcgcggctacaccgtccacgccaccgtccaaaatctcagttcctctccctttccggcgtcacctttcgcgtcgcgtttgctcggttcgttctgttctttcgtgattgccggaagctaatcccgcatcggtttttgggtttttttttcccgcggttttgcagaagatgaagccgagacgaagcatctggaagccatgccgggagcggcctcccgcctccgcctcttctgcatggacctcctcgactacgactccgtcctcgccgccgtccgcggctgcgccggcgtcttccacctcgcctctccctgcatcgtcgaccgagtccgcgaccccgagaaggagcttttggacccggccatcaaagggacggccaacgtcttgacggcggctaaagaagtcggggttcggcgcgtggtggtgacgtcctccatctccgccatcacgccgagcccttcttggcctgttgaccgagtgaaggctgaagattgctggactgatcttgactactgcaagcagaatgggttgtggtatcccgtttccaaaacactagccgaaaagactgcttgggactttgctaaggagcatggattagatgtggttgtggtgaatcccggaacggtcatgggtcctgtcatccccccgagactcaatgcaagcatgttaatgctccaacgccttcttcaggggtgcactgacacataccaagactttttcatgggatctgttcattttaaagatgttgccttagcacacattctggtttacgagaatgaatcagccaaaggaaggcacttgtgcgttgaggctatatcacattatggcgattttgtggccaaggttgctgagctttaccctgaatacaacttgccgagattacccaaggatactcaaccagggttattgaggacgaagaacggagctaagaagctgatggacttgggattggagtttatccccatggaacaaatcatcaaggattctgtggagagcttaaagagcaagggcttcatttcatgaacgcatctcagagaattcttgggaaccaacatatgcagtgatgtatcctagctgtggcctgcggtgacgccgtactaatgttgtaatcagcgattgagttataatggatgaattgccagtgccctggagaaaagggtgaacatattatctaggaaaccgtgatgcatcctgggaaactccttaaagtctttcaacgttatctttcttgcacggtcctagcaatgatttcatcgccgatattcacatgttaagtcgtgtccaatggcgtattcgatactcaaaagtgatcggcgccaaggccgtcaaactacgataagatgccatgtaactatcataggaccaaagccccttatccgcccaaggtcggaaatcgggctacatgcatttgtacgaccgtgatgcttctaatagatgtatgtggtataaaaagcgggcctgggacatttctatggcagcggaatggtaattctctcgcgtcacaaggagacacgtgtagttcgcgacgaaatatttcacggtccagattttatcctcccgatgtctgatggatattttttttggagcttactccttaaaagagcaatttatgtgcaagaggccagaaggtattagcgggacttggcagccgagttggtagagggattcggccggtggttaagcctaaatcctaggcagtcgcgaatggagaaccggtcggcggcccgtctccgtgacgctatctggacctgttcgtggctgatcctgttggctagcccattagcggcggccgcggccggtcccggtcgggagggaggcaaggtggagctggcgctctactacgagaccctctgtccctactgctccaatttcgtcgtcaaccatcttttcaaggtcttcgacagcggcctcatctccatcctcgatctcaagctcgtcccttacgggaacgcccgcatcggtgccaacgacaccgtcacttgccaggtccgattcagtttcgcacgcgctcatttcgtttttcctcctttaatttccacgatcgtcgctctggccggcggacacctgtcgatccatctccgctcgtcaccgaacgctcgtcacgtcgtcatcgtcatcgtcatcgtcgcatgtctactggactcggagcgggcagataaaagccccgaccgagcctgaaatcctcgaacgatttagcttgatcgtgggcgcgatccgacatgcattccgcgtctgacctagcccgccgctctctcctgacctgcctgtgcttgatcggcgttctctccacttcttcgtcttccgaaatcgccttaccttcagagtcctccaataaggtgtccttgggtttgtattacgagtccctttgcccttacagcgccgatttcgtcgtcaatcacctccccaagatcttcgacagcgacctcgtctcccatgtcgaccttcacctcgtcccttggggcaatgccaaaatgagaggcaacgccacctttgattgccagcatggaccgtgggaatgcctgctcaacaccgtggaagcatgcgcaatcgacgtctggcccgacttgagcgagcattttcctcttatctattgcattgagaagttggtgtattcgcatgactacgcccagtgggaatcctgctttgagcctttaggattggattcaaaacttgtctcagactgttatgctggtgggcgagggaaagagctggagctggaatatgcagctgaaacaaatgcacttcagccccctcatcagtatgttccttgggtcgtggtggatgggaaaccgctttatgatgattatataaactttatgagctacatctgtgaggcttacagtggtactgccaagcccgaggcatgcagtaaactctctttgaatcgggtccaactaagggaagcacgtaaaagtctcccagtctgttacctgaaggagaaaatgtcatcaccggcatttaaagtagtgagatcagctgtggagtcaatgatgggttggacaaagatgctgcttgatgcgtaagaggtttgcggccctctatgttttcaattaatctccgtgcttgaacttgttcggaagcaagtcccatgagaagggttaaagttcttgagttgtgtcctagtactttctggatcatagttgttgtcttgagctgtaaatgtttgtgctgttttgctgatcttgactttgtttatatctttatatggtccacatattttagaattggcatggtgttcagctgcctccatatccttctaccctcgcctggttgcaagtgaaggctaaggttttaggaaattggacgcttttgaatttgaatatgtagctttgattagtgcagattacagaatcactaaaagcttttcagaaaaaaaaaa

SEQ ID NO: 124 - DNA, 1243 bp, Eucalyptus grandis
gcaacactccaaagtacgagtatcgcatccccgatcgcacccatgacaagtaaaacggcggcgccagccgaggacatgcagccgcagccgcagccgcagccggagccgaccaaaaggggagccgtgctcgtcaccggcgccaacggcttcatcggctcgtggctggtccgcgccctcctggactccggctaccccgccgtccgcgcctccgtcttcccgggctccgacgcctcccacctcctcgccctcccgggcgcctccccctcccgcctcctcatctccgaggccgacgtcctcgacgccgccgccgtcgcccgcgccgtcgacggctgcgccggcgtcttccacgtggcctccccctgctccctcgaggcccccgccgaccccgagcgcgatctcctccgccccgccgtccagggcaccctcaacgtcctcgaggcggcgaggcgcgctggcgtccggcgcgtggtcctcacctcctccatctccgccctcgtccccaaccccggttggcctcctcacaagcccttcgacgagtcctcctggaccgaccttgactactgcaagcctcgccagaaatggtatccggtgtcaaaaactctggcagagaaggcggcgtgggagtttgcggagaagcatggactggatgtggtcgcgatacatccggccacgtgccttggccctctattgcaaccaggtctcaatgcaagcagtgccgtgttgctgcagctgcttcagggatcgacggatactcaggaatatcactggctcggggctgttgatgttagagatgtggccagggcacaggtcttgttgtatgagacaccggcagcatctggtagatatctctgcacaaatggtatctatcagtttggtgattttgctcaaagggtcgcgaagctcttccctgagtttcctatccacaggtttacgggagaaaccaatccgggtttggcagcatgtgaagatgcagcgaagagattgatcgatctggggttctccttcacgcctcttgaagacgccatcagagaggcggttgagagcctcaaagcaagaggttacttgcgaggataatcacgttgttaggggtttttcttcttcttttattttgctaaactaaactaatcgcagtgtttcagtttttatgtttgtttaatcccttggtcctttgagcaaacgagtaaaggtgcttctgtaatcataagtttaaacttctttgcgaagcgttcttccaaaaaaaaaa

SEQ ID NO: 125 - DNA, 1296 bp, Eucalyptus grandis
gataggataattttcgaaagtcttcgcgtcaattctcgctggcgcactaagaagaccgcagtgctgtggccattagtcttcaaaagttcgagctcgtgcgtgtgcaaagagagggagagagagagagagagagagagagagagagagaggatagcgatggcggagaggacgttgtgcgtgacgggagctggaggctttcttgcttcgtgggtcgtcaagattcttctctccaagggctacgccgtccacggcaccgtcagagatcccagtgatgcaaagtatgctcacttgaagaaactggataaagcatctgagaaattgagactcttcaaggcagatttactggattatgattctctccgcttggcaattgaaggatgctgtggggttctccatgttgcttgtccagtcccttcctcctctgtgtcaaatcctgaggtagagctgcttgcacctgcagttaagggaacacttaatgtgctgaaggcatgctctgaagcgaaagttaagcgagttgtatatgtatcctcggttgctgcaatgatgatgaaccccagttggccaaagggtcaagcgatggatgagctgtcctggtctgacaaggagtactgtcgcaggactgagaactggtattgcctttcaaaaactgaagcagaaagtgaagctttagagtatgcaaaaataaatgggcttgatgtcatatcggtatgtcctagtctcatatttggcccagttctgcagtcaacactcaacgcaagcacaacggccctcttaaacttaatgaaaggagggcaggagtcagtgccaaacaggttgaggaatttagtggacgtacgtgatgttgccgcagctgtaattttggcatatgagaaatctgaggcggaaggacgatatacatgcacatctcactgcattaagacacgggacttggtggaaaagctgaagagtctgtatcctaactacaattatcctcatagctttactgagaccgaagaagggattactctcagctcagagaagttacaagggctcggttggacttacaagccactggaggaaactctggttgattcagttgaaagttaccgtgcttctggactattggaagtaaagtagttctcttgttgggttagtttctgccccaggattggtcgttgctgaattgttgtcgacaagaacattgtattctggcaataacacacagacatcgttttgttgtagcatagaggttgccattgctgttcaggcttgttaaataaagcctggatgatctgttgaccgttgagaaaaaaaaaa

SEQ ID NO: 126 - DNA, 1838 bp, Eucalyptus grandis
atccacatagtaagagcgccacgagagagagagagagagagagagagagaggatgagatcaggagcttgttctgctcttcttcttcttcttcttcttcgtctgctgttgattcatggtctctccttgccgctcgcaagctcaagaaccaccgtccacagaggccaattccctccctccttcctgtttggcaccgccacttcctctttccagattgaaggggcctacctgcaggggaacaaaagcctcagcaattgggatatcttctcacacataccaggcaaaatagaagatggaagcaatgctgacgtgacggataatcactataatctctttatggaagatatagagttgatgtgtgatctcggggtggatgcatacaggttttccatatcttggtctagagttcttcctaagggaagattcggggaggtcaattcagaaggcattgagttctacaacaatctcattgatgcccttttggtcaaagggataaagccgtttgtgacgttgaaccattacgacattcctcaactgctcgaagaccggtatggtgggtggttgagttccgaaatacagctggattttggctactttgcacaagtctgtttcgaagctttcggagatagagtgacttattggaccacatttaatgagcccaacgtgttcatctatgatggttacgtggtggggacttaccctcctggccggtgttcctacccattcggcaattgctcctacggcgactccgctctagaaccctacattgcaacccacaatctggtgttgtcccatgccacggccgctcaaatttaccggaagaattaccaggaaaaacaaggaggaatgattggtatagtgatttctgctgcatggtacgagccgtacagcgacactccggccgatcgtttggctgtccaacgagctttagctttcgattttgcatggtttgtagaccctttcgtatatggagattatccgccggagatgcgtcaaatcgtgggttcgagattgccgacattttcggcggaagagcggaacaaactcgacgcaaagttggatttcattggaataaatcactacacgactaaatacgcgaaggactgcatgttctctccatgcacttcgccttactctctaggggaggcgttcgtgtatgtcaccggagaaaaggatggagtttacatcggcgaacggactgcaatgtcggatttcttcatcgttccgaggggcattgaagggatcgttacctacgtcaaagaaagatacaacaacacgcccatgttcatcaccgaaaacgggtacgcgcaatttgcgggtccaatcgatgactcgctgaatgacacaaagagaatagagtaccatgagggctatcttgccgtcttaagtgaagttgtgagaaaaggagccgatgtgaggggatatttcatctggtctctactagacaacttcgaatggctccatggatatttggtccgatttgggctgcattacgtggacttccaaacactgaagagaacacccaaatggtcagcgacgtggtgcaaggagttcctctctgaaggcaataatactcgaccgattcggaaaacatccacctacgaaatgtagcatcgtgtgtcttggaaacaattatcatgtgtgtaataatagaatatccttgcgatattgtcctaacttgatcacatggtaagtcaagttggggtcctaatttttttgagtgccccaggttgtatttgagacagtgaacagcaaatgcttgtatacacaatggattttttacttctaaaatctggaactaagctgtatttctactcttctgattgccgtgaacataaat

SEQ ID NO: 127 - DNA, 1936 bp, Eucalyptus grandis
gcagagaatgatcagatgatgtggagaggctaactttcaagattttttacaccatccttgctccataaataaacagtcgctctccttcacaaggcaaagctaaactctccctctctctctccctcttgagagtgttgaagtgtcaggatgaggattcgagtgccgtcgatgctgttgttgtggtcactgttgggcctcgtggcgaggtcgacaatggccgaagagacggtgatccccgagacaacgcgtttcgacaccggtgggctgagcagatcggccttcccgaagggcttcgtctgggggacggcgacctcggcttatcaagtcgaaggcatggccgacaaagagggacgcgggcctagcatctgggacgtcttcgtcaagattccaggaattgtggccggtaatgcaactggggaggtctcggtggaccagtatcatcggtacaaagaagatgtggatctaatggcgaagctgaatttcgatgcctaccgcttctccatttcatggtcgaggattttccctgatggaaccgggaaggtgaattggaagggagttgcttactacaacaggttgatcgactacttgcttagcaaaggcatcacaccctacgcaaatctgtatcactatgatcttccagaggctttagagaagaagtaccagggactgttgagtcccaatgtagtgaaagattttgccgattatgcagatttttgcttcaagacatttggcgatagagttaagaactggatgactttcaatgagccaagagtggtggctgctcttggatatgataacgggttctttgcccctgggaggtgctcgaaagcctatgggaactgcacagcaggaaactcaggaaccgagccttacattgtggcccatcatttgatcctgtctcatgctgcagcggttcagagataccgagaaaagtatcaagagaagcaaaagggaaggattggtattcttttggattttgtttggtacgagcctcttactagatcgaaggccgacaattatgcagctcaaagagcaagagactttcacgttggatggtttattcatccaattgtgtatggagagtacccgaggacaatgcaaaatattgtcggggacaggctgccgaaattcaccaaagaagaggttaagatggtgaagggctcaatggattttgtcggcattaaccaatacacagcttactacataaatgacccgaatcagccgaaagctaaagtcccagggtatcagcaggactggaatgccggatttgcctatgcaaaacttggagtgcctattggtccaaaggcacattcttactggctttataatgtaccctggggattgtacaaagctgtgatgtacatcaaggagcgttatgggaacccccccgtgattctgtccgaaaacggcatggatgatccgggcaatgtcacgctttctcaaggactgcatgacaccacgaggatcaacttctacaagggctacttaacccaactgaagaaggctgttgatgatggagccaatttagtgggctacttcgcatggtctttgcttgacaacttcgagtggaggttgggatacacatcacggttcggaattgtctatgtcgactataccaacctcaagagatacccgaaaatgtcagcctattggtttaagcagctgctcaccaggaaaaagaactgaggtgacccaaagatgaagtttttttccttggtttagaattcagaaaagaataattgacttcaatcatgaagtgcttgtcatcatgaatggtgaggttctgctgttttcttcgttctcaggttctatgttttgccttcttttggtaaaaagagggtgctgacgaatttgaccttaaggcgagtcaatgtaataaaagaaatggtgttgcatgacaatgctgtaatttgcaaggttgagtcgaaaaaaaaaa

SEQ ID NO: 128 - DNA, 1936 bp, Eucalyptus grandis; identical to SEQ ID NO: 127

SEQ ID NO: 129 - DNA, 2328 bp, Eucalyptus grandis
cctcgtgccgaaactctccctctctctctccctcttgagagtgttgaagtgttaggatgaggattcgagtgccgtcgatgctgttgttgtggtcactgttgggcctcgtggcgaggtcgacaatggccgaagagacggtgatccccgagacaacgcgtttcgacaccggtgggctgagcagatcggccttcccgaagggcttcgtctgggggacggcgacctcggcttatcaagtcgaaggcatggccgacaaagagggacgcgggcctagcatctgggacgtcttcgtcaagattccaggaattgtggccggtaatgcaactggggaggtctcagtggaccagtatcatcggtacaaagtgggtgtttctttccttgtcgccgtctgtttgtaaggttcttatcggtccgtgactgaaagatctctcgatgcattcatagatgggacaaaaagatcccttttcaaagatagtgtggtctgtgaaagaaagacagaaggaatctattatttacattggacctctagagggctaaaacaaaagattttcgttcagacacacatatggtgtcctaatatttccaagctttgtttaatttatatcacatttgacaatttattatagttcttatgtacggtccattcatatattcgctttatggtcctgcttcttaacaattttctgagagaaacggtttctcaaatgtgatatcttaataatcaaagctctttcctagtgtagttcaacccgcttgatattgtgcataaagaaacatgaacccgccataattatgtcctggttccacttagcggtgtatccaatatgtttccgcgcactaatcaatcgtgtcgtgctgttacaggaagatgtggatctaatggcaaagctgaatttcgatgcctaccgcttctccatttcatggtcgaggattttccctgatggaactgggaaggtgaattggaagggagttgcttactacaacaggttgatcgactacttgcttagcaaaggcatcacaccctacgcaaatctgtatcactatgatcttccagaggctttagagaagaagtaccagggactgttgagtcccaatgtagtgaaagattttgccgattatgcagatttttgcttcaagacatttggcgatagagttaagaactggatgactttcaatgagccaagagtggtggctgctcttggatatgataacgggttctttgcccctgggaggtgctcgaaagcctatgggaactgcacagtaggaaactcaggaaccgagccttacattgtggcccatcatttgatcctgtctcatgctgcagcggttcagagataccgagaaaagtatcaagagaagcaaaagggaaggattggtattcttttggattttgtttggtacgagcctcttactagatcaaaggccgacaattatgcagctcaaagagcacgagactttcacgttggatggtttattcatccaattgtgtatggagagtacccgaggacaatgcaaaatattgtcggggacaggctgccaaaattcaccaaagaagaggttaagatggtgaagggctcaatggattttgtcggcattaaccaatacacagcttactacataaatgacccgaatcagccgaaagctaaagtcccagggtatcagcaggactggaatgccggatttgcctatgcaaaacttggagtgcctattggtccaaaggcacattcttactggctttataatgtaccctggggattgtacaaagctgtgatgtacatcaaggagcgttatgggaacccccccgtgattctgtccgaaaacggcatggatgatccgggcaatgtcacgctttctcaaggactgcatgacaccacgaggatcaacttctacaagggctacttaacccaactgaagaaggctgttgatgatggagccaatttagtgggctacttcgcatggtctttgctcgacaacttcgagtggaggtcgggatacacatcacggttcggaattgtctatgtcgactataccaacctcaagagatacccgaaaatgtcagcctattggtttaagcagctgctcaccaggaaaaagaactgaggtgacccaaagatgaagtttttttccttggtttagaattcagaaaagaataattgatgtcaatcatgaagtgcttgtcatcatgaatggtgaggttctgctgttttcttcgttctcaggttctatgttttgccttcttttggtaaaaagagggtgctgacgaatttgcccttaaggcgagtcaatgtaataaaagaaatggtgttgcatgacaatgctgtaaaaaaaaaa

SEQ ID NO: 130 - DNA, 1846 bp, Eucalyptus grandis
cgttttctgaaagcacagaagggagcttctgagtgaaacgggaatggaggtctctcaactcaagaaagccatcttcatcatccagatagtcttagcttcactcttcacttcctccaactccatcatgacctcggatggtccatcatcactccccgtcaacttcctctttggcacagcctcttcttcttaccagtttgaaggagcttacaagagtgatggaaaaggccttaacaactgggatgtttttgctcacgaaccaggaaacataatcgatggaagtactggcgacattgccgtggatcactatcatcgttatctggaagacataaggctaatggagtcacttggagtgaacagctatcgtttctcaatctcatgggcaagaattcttcccaagggaagatttgcagaaataaacatggctggaatacactactataacagactcatcaatagtctccttcaaaagggaatacaaccctttgtaacattgactcactttgacataccacaagaacttgaggatagatacggaggctggctcagtccaaaatcacaggaggattttggatattttgcagatatttgctttaggtactttggagaccgggtaaagtattgggtcaccttcaatgagccgaacatccaagcaacattggcgtaccgctggggtgaatttccacctgcccgctgctctgctccatttggaaactgcacccttggagattcggagatggagcccttcatagtagctcataacatgatcttatcacacgcaactgcagttaacatttacaggacaaactaccagaaggaacaaggtggcatcattgggattgtcatacacgcggcatggttcgagcccatcagcaactctttagcagacgagttagctgcagagagagctatgtctttctttatgagctggtttttggacccaataatatttgggaaatatcctgcagagatgatcgaaattctgggatccattttacctgaattttccagaagtgaccaggagaaactgaagaagggattggactttatcggcatcaatcactacacaagttactatgtgcaggactgtattttatctatttgtgaaccaggtaaaggaatcaccaagacagaagggtactacaaacaaagctcagaaaagaacggtgtaccaataggacaacctactgacctggagtggttaaacgtctacccccaaggaatggaatatatggtaacctatgtcaaggagaggtataacaacaccccaatgtttatcacagagaatggttatggcgaaaaggatgaccttaaactcaaagatgaaaagcccctggaagatctgaaaagagtagagtacatggccagccatttaagtgctcttctttcagcagtgaggaaaggagcagatgtgaggggttattttgcatggtccttgctcgacaattttgaatggcaatttggatatacagagaggtttggacttcaccatgtcaacttcaccacattgaagagaactcccaaactgtctgcaagttggtataagcagtttattgcagaacacagtatcagaaccataacagatccagaccatccaaatctgtagcagatttattgactaggttaatgtccgccgctgagtaacagttccaggctcaagaatctaggggtaaaaaaggaattactgtaaggtcttatctatagcacgctatctaggcaaaaggaaagccttcatattttattatcattcagtggcctactcacaaaaatgtatccagttatttactgaatgtactgcatgtttagataacatcaatggcatgatttatcatcacatgcaaaaaaaaaa

SEQ ID NO: 131 - DNA, 1798 bp, Eucalyptus grandis
ttgctttttctgaaagcacagaagggagcttctgagtgaaacgggaatggaggtctctcaactcaagaaagccatcttcatcatccagatagtcttagcttcactcttcacttcctccaactccatcatgacctcggatggtccatcatcactccccggcaacttcctctttggcacagcctcttcttcttaccagtttgaaggagcttacaagagtgatggaaaaggccttaacaactgggatgtttttgctcatgaaccaggaaacataatcgatggaagtactggcgacattgccgtggatcactatcatcgttttctggaagacataaggctaatggagtcacttggagtgaacagctatcgtttctcaatctcatgggcaagaattcttcccaagggaagatttgcagaaataaacatggctggaatacactactataacagactcatcaatagtctccttcaaaagggaatacaaccctttgtaacattgactcactttgacataccacaagaacttgaggatagatacggaggctggctcagtccaaaatcacaggaggattttggatattttgcagatatttgctttaggtactttggagaccgggtaaagtattgggtcaccttcaatgagccgaatatccaagcaacattggcataccgctggggtgaatttccacctgcccgctgctctgctccatttggaaactgcacccttggagattcggagatggagcccttcatagtagctcataacatgatcttatcacacgcaactgcagtcaacatttacaggacaaactaccagaaggaacaaggcggcatcattgggattgtcatacacgcggcatggttcgagcccatcagcgactctttagcagacaagttagccacagagagagctgtgtctttctttatgagctggtttttggacccaataatatttgggaaatatcctgcagagatgatcgaaattctgggatccattttacctgaattttccagaagtgaccaggagaaactgaagaagggattggactttatcggcatcaatcactacacaagttactatgtgcaggactgtattttatctatttgtgaaccaggtaaaggaatcaccaagacagaagggtactacaaacaaagctcagaaaagaacggtgtaccaataggacaacctactgacctggagtggttaaacgtctacccacaaggaatggaatatatggtaacctatgtcaaggagaggtataacaacaccccaatgtttatcacagagaatggttatggcgaaaaggatgaccttaaactcaaagatgaaaagcccctggaagatctgaaaagagtagagtacatggccagccatttaagtgctcttctttcagcagtgaggaaaggagcagatgtgagggggtattttgcatggtccttgctagacaattttgaatggcaatttggatatacagagaggtttggacttcaccatgtcaacttcaccacattgaagagaactcccaaactgtctgcaagttggtataagcagtttattgcagaacacagtatcagaaccataacagatccagaccatccaaatctgcagcagatttattgactagcttaatgtccgccgctgagtaacagttccaggctcaagaatctaggggtaaaaaaggaattactgtaaggtcttatctatagcacgctatctaggcaaaaggaaagccttcatattttattatcattcagtggcctactcacaaaaatgtatccagttatttagtgaaaaaaaaaa

SEQ ID NO: 132 - DNA, 1650 bp, Eucalyptus grandis
acaaaacccaagaaaaagaaaaggaaaggatgagatcacaaccttgttctattcttcttcgtcttcttttgatacatggtctcttcttgcgactcacaagctcaagaaccaccgtccacagaggccaattccctccctccttcttgtttggcactgccacctcctctttccagattgaagggggctacctgcaaggtaacaaaagcctcagcaattgggatgtcttctcacacatgccaggcaaaatagaagatggaagcaacgctgatgtggcggatgatcactataatctctttttggaagatatacagttgatgcatagtctcggggtggatgcatacagattctccattgcttggtctagagttcttccccaaggaagatttggagaggtcaattcagaaggcatcgaattctacaacaatatcattgatgcccttttggtcagagatattaagccgttcgtgacgttgaaccattacgaccttccccaattgctagaagaccggtatggttcgtggttaagttccgaaatacagttggactttggctactttgcacaagtttgtttcgaagctttcggagatagagtgacgtattggagcatattcaatgagcctaatgtgctcatctatcatggttacctcttgggaacttacccgcccggccggtgctcctacccgtttggtaattgctcctatggtgactctgctctagaaccctacattgcgacccacaatctggtgttgtcccatgccacggccgctgaaatttaccggaagtattaccaggaaaagcaaggaggaatgattgggatagtaatttcagctccatggttcgagccgtacgacgacaccccagccgatcgtcttgctgtccaacgatctttagctttctatattgcatggtttgtagaccctttagtatatggagattatccgccagagatgcgtcaagtcctaggatcgagattgccgacgtattcggcggaagagcggaagaagctcctggagggaaagctggatttcatcggagtaaatcactacacgactctttatgtgaaggactgcatgttctcttcatgcgcttcaccttactctctgggggacgcgttcgtgtatctcactggagaaaaggatggagcttacatcggcgaacggaccgcgatgccgcttttctttgtcgttccgaggggcatggaagggatcgttacgtatgtcaaagagagatacaacaacacgcccatgttcattaccgagaatgggtacgcacaacctgcaggtgcaatcaaagattcgctaaacgacacgaagagaatagagtaccacgagaactatctcgctgtcttaagtgaagttgtgagaaaaggagcggatgtgaggggatatttcatatggtctctgctggacaacttcgaatggctatacggatatttgatacgatttgggctgcattatgtggactttcaaacactgaagagaacacccaaatggtcagctacgtggtacacggagttcctctctgaagataacaaaattcgagcgattcgaaaaacatccacctacaaaatgtagcatcctgtgtctttaaaactattaagagatcatatctttcgaagatctctaacggtaaaataaaaaaaaaaaaaaa

SEQ ID NO: 133 - DNA, 2164 bp, Eucalyptus grandis
actgacgtgattctctctctgtcctgcaattcaaatccgtcacttctcttttcgacctttactttacggtgattccatttctgcacaacaaaacaagatttccataaagagagaagaagaaaaggaaagggaatgatagctgttacaaccagagaagagaggtattacgagcgtgattgatgtgcctgtggtgatgtgtgactgtgatctctgaaggagacccagatacgggacagagaagatgacgaagaaattaggtttcttgttgcggcttttggtagtgggtctggtgatagcagagacggtccatggtgcttatgagttcagcagatacgactttcctcctggctttgtgtttggtgctggcacttcagcttatcaggtcgaaggagcagcaaatgaggatgggaggactccaagtataatggacacctgggcccactctgactcagggattacaagcggagcaaatggagatattgcctgtgatcaatatcacaaatacaaggtagatgtccaactcatggcagaaatgggattagacgcataccggttttccatctcatggtcaaggctcatcccaaatgggagaggctctgtgaatccgaagggattgcagtactacaacaacctcatcaatgaactgatcagccatgggattgaaccgcacgtgaccctgcaccattttgatctgccacaggctcttgaagatgagtatggaggatggataagtcgaaatattgtgagagatttcgcggaatatgcagatgtatgtttcaaaatattcggagacagagttaaatactggacaaccttcaacgaggccaatattttctcgatggctggttatgacctcggattcatgccgccaagccgttgctcttctccatttggattccttaactgcaccagaggagattcgttattggaaccatacttggcagctcacaatatcttattgtcacatgcatcggccaccagattgtattggaaaaagtaccagaacatacagaagggatacatagggcttaaccttctgagtttctactctgttcctttcacaaacaaaacggaagacgtaattgcagctcgaagggttactgactttttcatgggttggtttgtggaaccgctggtgtatggggactatcctgaggtgatgaagaataatgcaggatcaagactcccttcctttactgctctcgaatctcaaagagtcaagggttcatttgatttctttgcagtcaatttctacagcgcaaactatgtcaaggacaatccagaaagcctgaacatcgaaccgagggactatttcacagacatggctgtacagtggaaatataagcaaggaaatgcatcgtcatttatgaatagatttccgccttcatttgagtttccgcttactccatggggtctgcaaggcgtgctggagttattcaagcaaaattatggaaaccctcccatttttatctatgaaaacggtcaaaggatgcagagaaacacgtcacttgaggactggccgagaattcaatatttgcaggagcatatcagtgtcctgctggatacagtgaggaatggctcgaatgcgaaaggctacttcacatggtccctcctagacgtgttcgagctgttggatgggtacaggtcgggctatggcctgtactatgtggacttggacgaccctgagctgaggaggtacccgaagctctcagccaagtggtactcacgcttcctgaagggagggagcatcactccggacagcagcatcgagctcgagggcaattggtcctccctctcttctgctcaagccatgaggtgaaattaaattcctggttccttgaggtgcgagtcattttcttgggtagcttcattcacgattcaggttcaactcaagtcaaggagcatgtgaatgttctctcttttgtccagaattttcctagtatgtacttcatcatgctgttgggaagattcacggatggtgcgagctatttagcgtgactgtaaatctttgaatttcctggttccaaatgtcagtcttagcatatggagaatagatgaacgtacataaaagaattgctttgcaatttattagtaggggccgtcgagtggttttgtatcattatatcagattccaagtcaatcgtccttatgcctaaaaaaaaaa

SEQ ID NO: 134 - DNA, 2069 bp, Eucalyptus grandis
atagctgttacaaccagagaagagaggtattacgagcgtgattgatgtgcctgtggtgatgtgactgtgatctctgaaggagacccagatacgggacagagaagatgacgaagaaattaggtttcttgttgcggcttttggtagtgggtctggtgatagcagagacggtccatggtgcttatgagttcagcagatacgactttcctcctggctttgtgtttggtgctggcacttcagcttatcaggtcgaaggagcagcaaatgaggatgggaggactccaagtataatggacacctgggcccactctgactcagggattacaagcggagcaaatggagatattgcctgtgatcaatatcacaaatacaaggtagatgtccaactcatggcagaaatgggattagacgcataccggttttccatctcatggtcaaggctcatcccaaatgggagaggctctgtgaatccgaagggattgcagtactacaacaacctcatcaatgaactgatcagccatgggattgaaccgcacgtgaccctgcaccattttgatctgccacaggctcttgaagatgagtatggaggatggataagtcgaaatattgtgagagatttcgcggaatatgcagatgtatgtttcaaaatattcggagacagagttaaatactggacaaccttcaacgaggccaatattttctcgatggctggttatgacctcggattcatgccgccaagccgttgctcttctccatttggattccttaactgcaccagaggagattcgttattggaaccatacttggcagctcacaatatcttattgtcacatgcatcggccaccagattgtattggaaaaagtaccagaacatacagaagggatacatagggcttaaccttctgagtttctactctgttcctttcacaaacaaaacggaagacgtaattgcagctcgaagggttactgactttttcatgggttggtttgtggaaccgctggtgtatggggactatcctgaggtgatgaagaataatgcaggatcaagactcccttcctttactgctctcgaatctcaaagagtcaagggttcatttgatttctttgcagtcaatttctacagcgcaaactatgtcaaggacaatccagaaagcctgaacatcgaaccgagggactatttcacagacatggctgtacagtggaaatataagcaaggaaatgcatcgtcatttatgaatagatttccgccttcatttgagtttccgcttactccatggggtctgcaaggcgtgctggagttattcaagcaaaattatggaaaccctcccatttttatctatgaaaacggtcaaaggatgcagagaaacacgtcacttgaggactggccgagaattcaatatttgcaggagcatatcagtgtcctgctggatacagtgaggaatggctcgaatgcgaaaggctacttcacatggtccctcctagacgtgttcgagctgttggatgggtacaggtcgggctatggcctgtactatgtggacttggacgaccctgagctgaggaggtacccgaagctctcagccaagtggtactcacgcttcctgaagggagggagcatcactccggacagcagcatcgagctcgagggcaattggtcctccctctcttctgctcaagccatgaggtgaaattaaattcctggttccttgaggtgcgagtcattttcttgggtagcttcattcacgattcaggttcaactcaagtcaaggagcatgtgaatgttctctcttttgtccagaattttcctagtatgtacttcatcatgctgttgggaagattcacggatggtgcgagctatttagcgtgactgtaaatctttgaatttcctggttccaaatgtcagtcttagcatatggagaatagatgaacgtacataaaagaattgctttgcaatttattagtaggggccgtcgagtggttttgtatcattatatcagattccaagtcaatcgtccttatgcctcgtcatgcttaaatttatgtacgtaatctcaggccctccttgaaaaaaaaaa

SEQ ID NO: 135 - DNA, 1766 bp, Eucalyptus grandis
acctttggatgaaggatactgaaaatggagctgaagaagcagcatccacacggttatctatatgctaacactcgtggcggcgcctccgcctcctggtgcatcagcttgttgatgatcacggccactttcttgggttgcagttgtggtcgtgaggatcctggtgtggctggagtcaatggggacgatgacaagatcatcaaccggacgagcttcccatctgatttcgtatttggagtgggatcgagcgcctaccagtctgaaggagcagcggaccaacagggaagaggcttgagcatttgggacaccttcaccaaactctttccagataagattagcgaccactcttccggtttcatagctgatgagttctactaccagttccaggaggacataaacttgttgaaagcaatgggatgggatttcttcagattctccatctcgtggcctcgtattgcacctcatgggaagataagcaagggagtcaatgaacaaggtgtcgccttttacaacaatctcatcgacagcctacttgctgagggcatccaaccttttgtgacattgttccattgggatgttccccaagcacttgaagatgagtacggcgggttcctgagtattaatattgtggaggactacatcgattatgtaaacttttgctttcaaaagtttggtgatagagtgaagcattgggtgacactaaacgagcccaattactttacgttgtatgggtatgcaatgggcatctatgcacctggtcgatgttctagttacataaataactgcacagccggaaattcagcaacagaaccttacatcgttgcacaccatttacttctttctcacgcagcagcagtgaaactgtacagggacaactatcaggctactcaaaatgggaaaataggcatggtcattgcaacttactggatgacccctaagtattcaacgaacgtcagtaggaaggctgcctctagagcttttgactttcagtttggatggtttgcccatcctattacctatggtgactacccaaagtcaatgaggagatatgtgggcgagcggttacccaaattcacaaaagcacagtcagaggcgctaaagggttctcgtgactacatgggggtaaattattacacggcgagatacgtggacgaatccgcatccccttttaccactctcaatctaagttacaccaccgattgtcattgtaatatgaccgctgagaaagatggaattccaatcggccaaccgactgccgcggagtggctgtacatatacccaaagggtatcagagagttgatgcactacgtgaagaaaaactatttggatccgaccatttatgtgactgaaaatggaatggcagatgcaaataacaaatcattgccgcttgaagatgcacttacagatagattgagaataagttactttcagctgcatctctcaaatctctccaaggctatcgaggaaggagtgaatgtaaaaggatactttgcgtggagtttcctagacgacttcgagtgggtggagggttatacaacccgatatggcctcgttttcgtggattatgggaatgaactgaagcgatacatgaagcactcggcatgttggttccaaagtttcctacaaaaggataatgcaaccgttaactactccttgcggagcgatgcctagcagaagtcactaaagcccaaatccgcaagtctcttcctcgctgctgcgtttccaaaccccgtagtcccttttggatactatatgtactgatgctcagt

SEQ ID NO: 136 - DNA, 2423 bp, Eucalyptus grandis
acgataaaactctagaacgataatgacgtgattcctgcaattcaaatccgttacttctcttttcgacctcttactttatggtaattccaattttgctcggcaacacaagatctccataaagagagaagaaagatagctgttataaccagaggagaggcaccacgagcgtgatagatgtgcctgtggtgaagtgtgactctgatctctgaaggagacgcagatacaggacagagaagatgatgaagaaattggggttcttgttgcagcttgtggtagtgggtctggtgatagcagagacggtctctgctgctgatgagttcagcagatacgacttccctcctggctttgtgtttggtgccggcacgtcagcttatcaggtcgaaggagcagcaaatgaggatggcaggactccaagtataatggatacctgggcccactctgactcagtgattacaggcggagcaaatggagatattgcctgtgatcaatatcacaaatacaaggaagacgtccaattgatggcagaaatgggcttagatgcataccggttttccatctcatggtcgaggctcattccaaatgggagaggctctgtgaatccaaagggattgcagtactacaacaacctcatcaatgaactgatcagccatgggattgaaccacacgtgaccctacaccattttgatctgccacaggctcttgaagatgagtatggaggatggataagtcgaaatattgtgaaagatttcgtggaatatgcagatgcatgtttcaaaatattcggagacagagttaaatactggacaaccttcaacgaggccaatattttctcgatggctggttatgaccttggatttctgccaccaaatcgttgttcttctccatttggatactttaactgcaccagaggagattcatcattggaaccatacatggcagctcacaatatcttaatgtcacatgcatcggccaccagactgtatcggaaaaaataccagaacatacagaagggatacgtagggcttaaccttctgagtttctactctgttcctttcacaaacaaaacggaagacgtcattgcagctcaaaggtccaatgaatttttcttgggttggtttgtggaaccgctggtgtatggggactatcctgaggtgatgaagaagaatgcaggatcaaggctcccttccttcactgctctcgaatctcaaagagtcaagggttcatttgatttctttgcagtcaatttctacagctcaaactatatcaaggacgatccagaaagcctgagcattgaaccaagggactataaggcagacatggctgtagagtggaaatatacgcaaggaaatgcaatgtcatttatgaatagatttctgccttcgtttgagtttccacttactccatggggtctccaaggcgtgctggagttattcaagcaaaattatggaaaccctcccatttttatccatgaaaacggtctctctctctctctctctctctgcgggcagttaaaatatgatgttgacttccagcttctaacttaatgtttgaatgcgatatgagcagactagttcagaccatgagatctttcttttcatattcgataagttgaagtaaaagataaataagcaaacggttaagtcaagagtatcaacttcaatcaagacatgtcgtaaattatattgtcaaagcatcgttcaaggagactggtttgatagaggagtcagccatggagagaaaagggcgaagccatcgcttactgaaagaataagaaatcatattgttccaacattctactcaggtttctggattacaattcttttcgtggaatgtggttacacaatcaggaacttttggttgtctctttgcaggtcaaaggatgcagcgaaacacgacgcttgaggactggccgagaattcattgtttgcaagagcatatcagtgtcctgctggatacagtgaggaatggctcgaatgtgaaaggctacttcacatggtccctcctagatgtgttcgagctcttggacgggtaccagtcaggctacggcctgtactacgtggacctggatgaccctgagctgagaaggtacccgaagctctcggccaagtggtactcacgcttcctgaagggagggagcatcactccggacggtggcatcgagctcgagggcaatcggtcctccctctcttctgctcaagccatgaggtgaaattaaattcctggttccttgacgcacaagtcattttcttgggtagcttcattcactattcaggttcaactcaagtcaagtaccctgcgaatgtaccctgcgaatgtactctcttttgtccagtagtttcctcatatgtacttcatcatgttgttgagaagatttgtggagccggtgcaagctatcaagtgtgactgcggttctaaaaaaaaaa

SEQ ID NO: 137 - DNA, 2038 bp, Eucalyptus grandis
gacgtgacatcgttcggatgaagcatattgaaaatggagctgaagaagcagcatccacacggttatctatatgctatcactcgcggcgcctccgcctccgcgtccgcctcctcgtgcatcggcttgttgatgatcacggccactttcttgggttgcagttgtggtcgtgaggatcctggtgtggctggagtcaatggggaggacgacaagatcattaaccggacgagcttcccatctgatttcgtatttggagtggcatcaagcgcctaccagattgaaggagcggcggcggaccaacagggaagagggttgagcatttgggacaccttcaccgaactctttccagataagattagcgaccactcttccggttttatagctgatgaattctactacaagttccaggaggacataaacctgttgaaagcaatgggatgggatttcttcagattctccatctcgtggcctcgtattgcacctcatgggaagataagcaaggaagtcaataaacaaggtgtcgccttttacaacaatctcatcgacagcctacttgctgagggcattcaaccttttgtgacattgttccattgggatgttccccaagcacttgaagatgagtacggcgggttcctgagtcttaatattgtggaggactacatcgattatgtaaacttttgctttcaagagttcggtgatagagtgaagcattgggtgacagtaaacgagcccaattactttacgatattggggtatgcgatgggtatcaatgcacctggtcgatgttctagttacataaataactgcacagccggaaattcagcaacagaaccatacatcgttgcgcaccatttgcttctttctcatgctgcagcagtgaaactgtacagggacaactatcaggctgctcaaaaagggaaaataggcatggtcattgcaacttactggatgacccctaagtattcaacgaacgccagtaggaaggctgcctctagagcatttgactttgagtttggatggtttgctcatcctattacctatggtgactacccgaagtcaatgaggagatatgtgggcgagcggttacccaaattcacaaaaacacagtcggaggcgctaaaaggttctcgtgactacatgggggtaaattactacacagcgagatacgtggatgaatccgcatccccttttactgctctcaatctaagttacaccactgattgtcaatgtaatatgactgttgagaaagatgaaattccgattggccaaccgactgccgaggaatggttgtacatatacccaaagggtattagagagttgatgcactacgtgaagaagaactatcaggatccaaccatttatgtgaccgagaatggaatggcagatgcaaataacaaatcgttgccgcttgaagatgcacttacagatagattgagaataagttattttcagctgcatctctcgaatctctccaaggctatcgaggaaggagtgaatgtaaaaggatactttgcgtggagtttcctagacgacttcgagtgggcggagggttatacaacccgatttggcctcgtattcgtggattatgggaatggactgatgcgacatatgaagcactccgcgtattggttccaaagtttcctacaaaaggataatgcaaccgttaactactccttgcggagcgatgcctagcagatttacttcttgcatgatcgtcgtcttcatcgatataaatgagtggagagagtaatcactgggattgtttcttcaagtgaaacagattggatttctatttaccttgaggataaaggggctgcgtccctccaacgcttcttgttgccaaatgatagaataatttagaatgaattattggagtacggcggtcttattgtcagatgatacaattaatactgataacgtcatctttttggactgaactttcgttagtatgatgcatttagaagaggccgttgcttgtattgtacatttgccatagccccttgacatcaataacgatcaaacattatttttaaaaaaaaaa

SEQ ID NO: 138 - DNA, 1634 bp, Eucalyptus grandis
cccgcattctccaccgcgtaacctctctccatctccatctccgtagtcatctctctctctctctctctctctctctctctctctctctctgagttgctgtggggttgtgcttgggtaggtgggtgtgggtgagtgagtgagttggtgagtgatggcgagctcgttgtgactcgagtcgtcgccgagtgatgacccgtcgagtctctgatcttgggcactctctcgttcgagttctcaccctttcttcttctttggatggatctaaccatacccgtttgcgtgattgcttcgctgggtgtttaggtgcagaagatgagctcggagggtgggaaggaggattgcctcggttgggctgcccgggacccttctgggttcctctccccctacaaattcacccgcagggccgtgggaagcgaagacgtctcgattaagatcacgcactgtggagtgtgctatgcagatgtggcttggactaggaatgtgcagggacactccaagtatcctctggtgccagggcacgagatagttggaattgtgaaacaggttggctccagtgtccaacgcttcaaagttggcgatcatgtgggggtgggaacttatgtcaattcatgcagagagtgcgagtattgcaatgacaggctagaagtccaatgtgaaaaggcggttttgacttttgatggaatcgacgcggatggtacagtcacaaagggaggatattctagtcacattgttgtccatgaaaggtattgcttcaggattccagaaaactacccgatggatctagcagcgccattgctctgtgctggaatcacggtgtacactccaatgatacgtcacaagatgaaccaacctggtaagtctctaggtgtaattggacttggcgggctcggtcatatggcagttaagtttgggaaggcttttggactgaaagtcacagtgttaagtacaagcatttctaaaaaggaggaagcactgagcctgcttggggctgaccatttcgttatctcatctgacgtagagcagatgaaggccattgctaagtccctggactttataatcgacacggcagccggtgatcacccgtttgatccttacatgtctcttttgaagacgggtggcattctagcattggtcggcttcccgagcgaagttaaattcagtccagccagccttaacctcaatatgagaactgttacgggtagcgtaacgggaggaacaaaggatacccaagaaatgatagacctgtgtgcggcgcagaagatatacccaaacatcgaagtgataccaattgattatgccaacgaagctctggagaggctcatcaagagagatgttaagtatcgattcgtgatcgacattgagaactccttgaagtgacaccatcatttgttgaagtagttaactttcagtttttacgtgtcttcaataatgtaatagtggagtcctagtcaataggaagtggcctgtttttaggagttagtttctgcatatgttctggttagtggggtatgttagtgggtctttgttgttgttgttctatagctattttcttgctaagtggtttggatgttctgcctatttaataggcttatgttccgatgaataaagtaacgaaagttacagcaaaaaaaaaa

SEQ ID NO: 139 - DNA, 1634 bp, Eucalyptus grandis; identical to SEQ ID NO: 138

SEQ ID NO: 140 - DNA, 1298 bp, Eucalyptus grandis
cctcgactctgctcggctcatcaccccgcgctcccgcattctccaccgcgtaacctctctccatctccgtgcagaagatgagctcggagggtgggaaggaggattgcctcggttgggctgcccgggacacttctgggttcctctccccctacaaattcacccgcagggctgtgggaagcgaagacatctcgattaagatcacgcactgcggagtgtgctatgcagatgtggcttggactaggaatgtgcagggacactccaagtatcctctggtgccagggcacgagatagttggaattgtgaaacaggttggctccagtgtccaacgcttcaaagttggcgatcatgtgggggtgggaacttatgtcaattcatgcagagagtgcgagtattgcaatgacaggctagaagtccaatgtgaaaagcgggttttgacttttgatggaattgatgcggacggtacagtcacaaagggaggatattctagtcacattgttgtccatgaaaggtattgcttcaggattccagaaaactacccgatggatctagcagcgccattgctctgtgctggaatcacggtgtacactccaatgatacgtcacaggatgaaccaacctggtaagtctctaggtgtaattggacttggcgggctcggtcatatggcagttaagtttgggaaggcttttggactgaaagtcacagtgttaagtacaagcatttctaaaaaggaggaagcactgagcctgcttggggctgaccatttcgttatctcatctgacgtagagcagatgaaggccattgctaagtccctggactttataatcgacacggcagccggtgatcacccgtttgatccttacatgtctcttttgaagacgggtggcattctagcattggtcggcttcccgagcgaagttaaattcagtccagccagccttaacctcaatatgagaactgtttcgggtagtgtaacaggaggaacaaaggatacccaagaaatgatagacctgtgtgcggcgcagaagatatacccaaacatcgaagtgataccgattgattatgccaacgaagctctggagaggctcatcaagagagatgttaagtatcgattcgtgatcgacattgagaactccttgaagtgacaccatcaaagtggagtcctagtcaataggaagtggcttgtttttagtagttagtttctgcatatgttctggttagtgggatatgttagtgggtctttgttgttgttgttctatagctattttcttgctatgtggtttggatgttctgcctattta

SEQ ID NO: 141 - DNA, 1419 bp, Eucalyptus grandis
ctgcaaagtaggagggggcaaaagtcttcgttgaacctcccgtcctcgactctgctcggctcatcaccctcttcgcgctaccgcatactccaccaccaagatgagctcggagggtgggaaggaggattgcctcggttgggctgcccgggacccttctgggttcctctccccctacaaattcacccgcagggccgtgggaagcgaagacgtctcgattaagatcacgcactgtggagtgtgctacgcagatgtggcttggactaggaatgtgcagggacactccaagtatcctctggtgccggggcacgagatagttggaattgtgaaacaggttggctccagtgtccaacgcttcaaagttggcgatcatgtgggggtgggaacttatgtcaattcatgcagagagtgcgagtattgcaatgacaggctagaagtccaatgtgaaaagtcggttatgacttttgatggaattgatgcagatggtacagtgacaaagggaggatattctagtcacattgtcgtccatgaaaggtattgcttcaggattccagaaaactacccgatggatctagcagcgccattgctctgtgctggaatcacggtgtacactccaatgatacgtcacaagatgaaccaacctggtaagtctctaggtgtaattggacttggtgggctcggtcatatggcagttaagtttgggaaggcttttggactgaaagtcacagtgttaagtacaagcatttctaaaaagaaggaagcactgagcctgcttggggctaaccatttcattatctcatctgacctggagcagatgaaggccattgctaagtccctggactttataatcgacacggcagccggtgatcacccatttgatccttacaggtctcttttgaagacgggtggcattctagcattggtcggcgtcccgagcgaagttaaattcagtccagccagccttaacctcaatatgagaactgttacgggtagcgtaacgggaggaacaaagaatacccaagaaatgatagacttgtgtgcggcgcagaagatatacccaaacattgaagtgataccgatcgattacgccaacgaagctctggagaggctcatcaagagagatgttaagtatcgattcgtgattgacattgagaactccttgaagtgacaccatcaattgttgaagtagttaactttcagtttttacgtgtcttcaataatgtaatagtggagtcctagtcaataggatgtggcttgtttttaggagttagtttctgcatatgttctggttagtggggtatgttagtgggtctttgttgttgttctatagctattttcttgctaagtggtttggatgttctgcctatttaataggcttatgttctgatgaataaagtaacgaaagttacagcaaaaaaaaaa

SEQ ID NO: 142 - DNA, 1358 bp, Eucalyptus grandis
cggcaacttcccactacgataagcagcaagttttcggctctgtcgaatctctctccgagcaccactttgaaaaaagcttggatctttgagcaaaaatgggcagtcttgagaaggagaggaccaccacgggttgggctgcaagggacccgtctggcgttctctctccttacacttatagcctcagaaacacgggaccagaagatctttacatcaaggtgttgagctgcggaatttgccacagtgacattcaccagatcaagaatgatcttggcatgtcccactaccctatggttcctgggcatgaagtggtgggtgaggttctggaggtgggatcagaggtgacaaagtacagagttggtgaccgagtgggaaccggtatagtggttgggtgctgcagaagctgtggcccttgcaattcggaccaggagcaatactgcaacaagaagatttggaattacaatgacgtgtacaccgatggcaagcccactcaaggtgggtttgctggtgagatagtggttggccaaaggtttgtggtgaaaatcccagatgggttagagtcggaacaggcagcgccgctgatgtgcgctggtgtgaccgtgtacagccctctggtgcgctttgggctcaagcaaagtgggctgagaggagggatattggggcttggaggggttggccacatgggggtgaagatagccaaggccatgggacaccatgtgactgtgataagctcttctgataagaagagaacggaggcattggagcacctgggtgccgatgcttacctagtgagctccgatgaaaatggaatgaaagaggccaccgattcgctcgactacatttttgacactatccctgtggttcaccctctcgaaccttacctggccttgttgaagctcgatgggaagctgatcttgactggtgtcatcaatgctcctcttcaatttatctctcccatggttatgcttgggaggaagtcaatcactgggagtttcatagggagcatgaaggaaacagaggagatgcttgagttctgcaaagaaaagggattgacttcccagatcgaagtgatcaagatggattatgtcaacacggccctagagaggctcgagaagaatgatgtcaggtacaggttcgtcgtggacgtcgtgggaagcaagcttgattagttttgtcctttccccataattaaacaagaaatcgacgtgcttgtctctcaattcgagttcctcatgccctctgttgtatcattgtttgttataccgagagtattattttcttctgtcttcgtattgaaaccatagaccttctcgattgtgtattcaatgatgaaggtgttaatgattttatcaaaaaaaaaa

SEQ ID NO: 143 - DNA, 1358 bp, Eucalyptus grandis; identical to SEQ ID NO: 142

SEQ ID NO: 144 - DNA, 1420 bp, Eucalyptus grandis
atcagcttctcctcaatcatcgctcagactgggcaaatgggcagtgtcgacgcggagaggaagaccaccggctgggctgccagagacccttctgggactctcgcgccttacacttacgatctcaggagcacgggtcctgaagatgcttacatcagggtgctctactgtgggatttgccacagtgacattcaccagatcaagaatgaccttggcatgtctcgctaccccatggtccctggccatgaggttgtaggggaggtgctggaggtgggatcagaggtgactggtctgagagttggggaccgggtcggcgtcggagtcctcgtggggtgttgccgaaactgcacgccgtgcaaatccgacatcgagcaatactgcagcaagaagatctggtcttacaacgatgtttacactgacgggaagccaacccaaggtggctttgccggagagatggtcgttgctcaaaaattcctggttaaaataccggatgggatatcatcggagcaggcggcgccgcttctatgtgcgggggtcacggtgtatagtccgctgaaccacttcgggctgaagcagagcggcctgagaggaggaatactggggctgggcggggtcggccacatgggggtgaagattgccaaggccatgggacaccacatgaccgtgataagctcgtctgaccggaagagagaggaggcattggaccatcttggcgccgatgcgtacttggtgagctccgacgagactgggatgaaggaggctgctgattcactcgactatatcattgacacagtgcctgtgtttcaccctcttgagccttacctctctctgttgaagcttgatggcaagctgatcttgcttggtgtgatcaacactcctctccagttcctcacccctgtggtcatgggtggtaggaaggcgatcacggggagcttcatagggagcatgaaggagaccaaggagatgctcgatttctgcgaggaaaaggggataacctcccaaatcgaagtgatcaagatggactacatcaacgccgcgttcgagaggctcgagaagaacgacgtgaggtacaggttcgtcgtggatgtcgctgggagtaagcttgactgagcatgatgaaaggcgaagctagagcttgatgaagctggtggaatgtggatcatccccagacccacaagccaccagacagaagctgaaataaatatctggaaaagacaccaactcttatcttaagtctcaatccgatgtatgacaaaagtcccgcttaggttagctgtctttcgataaaataagacagcggaagtggacttctctttcatatgaatcgaagtgttttggcaagttttgcaaatgtgggatctcgaagtcgtggatggggtgttgaaaacgatgaataccaaacttatggcgtgtaaaaaaaaaa

SEQ ID NO: 145 - DNA, 1452 bp, Eucalyptus grandis
ctttgctcaaaagtcagaccccaaaatcttgtctgcacggaaacggaattgccaaggcttcgtgacatctggccttttgaccatttgaacttctgtttttcgttgaggtcgttgaggaacgatgagttcagatggtgcgaaggaagattgtcttggttgggctgccagagatccttctggacttctctccccctacaaattcagccgcaggaccgtgggaagcgatgacgtctcaattaggatcacacactgtggagtgtgctatgcagatgtgggttggactaggaatatgacgggacactccaagtatcctctggtgccagggcacgagatggttggaattgtgaaacaggttggctccagtgtccaacgcttcaaagttggcgatcatgtgggtgtgggaacttatgtcaattcatgcagagagtgcgagtattgcaatgacgggctagaagtccactgtgaaaagatggttttgacttttgacggaattgatacggacggtacagtcacaaagggaggatattctagtcacattgtcgtccatgaaaggtattgcttcaggattccagaaaactacccgatggatctagcagcgccattgctctgtgctggaatcacggtgtacactccaatgatacgtcacaagatgaaccaacctggtaagtctctaggtgtaattggacttggcgggctcggtcatatggcagttaagtttgggaaggcttttggactgaaagtcacagtgttcagtacaagcatttctaaaaaggaggaagcactgagcctgcttggggctgaccatttcgttatctcatctgacgtagagcagatgcaggccattgctaagtccctggactttataattgacacggcatccggcaatcacccgtttgatccttacatgtctgttttgaagacgggtggcattctagcattggttggctcgagtgaagttaaattcagtccagccagccttcaccacaatatgagaactgtttcaggtagcctaacgggaggaacaaaggatacccaagaaatgatagacctatgtgcagcgcagaagatatacccaaatatcgaagtgataccgatcgattatgccaacgaagctctagagaggctcatcaagagagatgttaagtatcgattcgtgatcgacattgagaactccttgaagtgacaccatcaattgtcgaagtagtgaactttcagtttttacatgtcttcaataatgtaatagtggagtcctagtcagtaggaagtggcttgtttttaggagttagtttctccacatgttctggtcagtggggtgtgttagtgggtctttgttgttgttgttctatagctattttcttgctaagtggtttggatgttctgcctatttaataggcttatgttctgatgaataaagtaacgagagttacagcaacaattctcttaaaaaaaaaa

SEQ ID NO: 146 - DNA, 1136 bp, Eucalyptus grandis
cagcagttacaatggcaaataccatgaaagcagcacgttttttaacacaaggaggtgaccttcagattgttgatatcgaaattcctcaaccaaaggcgggtgaggtgagaatgaaagtgcacgcgtgtggagtatgtaactctgataaagttgtgaagatgggcattttgggaaatccttatcctcgcactccagggcatgaggcggctggtgttgttgacgctgttggagagggtgtgagcaggttcaagaagggtgatcgtgtgggccttggctggtatgctggccactgtggaaactgtacaccttgtgaggagaacgtttggtcctgctgtgatcgaggccaaattgcaggtgtctcaatagatggtggatatgctgaatatgctgtagctcgtgaatcagcatttgccagaattcctgatgatctatcatttgaggaagccgccccattgatgtgcgcaggtgtcactgtgttcaacgccatgagaaatcaagacataaggccaggcgaacttgttgccattcagggtgttggcggccttggtcaccttgcggtgcagtatgctagcaagatgggttttaaggttgttgccatatcttctggtgcagacaaagagcagtttgccaaagaactgggcgcagcacactacatcaacgttggcccaggtgtagacgctgcggcagagctcactaagttggggggcgcgaagatgattgtggcgacggcgccaaacgcggagtcgatcaacccacttgtgaagggtcttaagattggcggaaaattgttagtagttggtttgccatttgagcctctgtcaatctctgtgtttgatctattacagcgaaatgcaagtgtgggatcctggtctgctggtgacagtagagattcggaggccactatgaagtttgccgctgccaaagacgtgaaagcaaaaattgagattttcccactaagtgaagcgcaaaaggcgtatgacagaatgatggaaaacaaagcacgtttccgttgtgtcctcaaaattgtataatcagtgactgttaatgttaagccttttgcgtgccataacaagggttaattatgtgaacttagtttttatataataaattcttgtaattacggctcaaaaaaaaaa

SEQ ID NO: 147 - DNA, 1542 bp, Eucalyptus grandis
ggggacacacacacacacactctctctctcctctctctctttcgtttgcttttcattgtttggtagatcctagaggcgaagcgatggcgaaatcgccggatcaagagcatccttgcaaggccttcggctgggctgcccgagacaagtccggccttctctcgcccttatgtttctctcgcagggaaaatggtgatgaagatgtcaccattaaaatcctcttctgtggggtttgtcattctgaccttcacgtggccaagaatgaatgggggttcacaaattaccctgttgtccctgggcatgaaatggttggaactgtgatgaaagtggggagcgatgtgaagaaatttaaagtgggtgagcgagtaggtgttggggtcatagtgggctcctgcaagaaatgtgagagctgccagcaggatctggaaaactactgcccccagacaatatttacctataattcccattacacagatggaacgaaaacttatggtggttactctgatatgatagttgttgacgagcgttatgtgcttcgtttccccgacaacttaccattggagggtggcgcgccactattatgtgctggaatcacggtgtatagcccaatgaaatactatggcatgacagagcctgggaagcatttgggtgtggctggacttggtgggcttggtcatgtggccgtgaaaatgggcaaggcttttggactaaaagttactgtcattagttcctctcccaaaaaggaaactgaggcgattgaaagactaggtgccgattccttccttgtaaccagtgaccctgcaaaaatgaaggcagctctgggaaccatggactacatcattgacacagtttctgctgtgcatcctcttcttccattgcttagtctgctcaagctgaatggcaaacttgttactgtgggattgcctgataagcccctagagctgcccatctttcccttggttctgggccgcaagcttgtggggggcagtgatataggaggcatgaaagagactcaggagatgctagacttctgtgcgaaacatggtatcactgcggatgttgaggtaatccagatggactacatcaatacagctatggaaaggcttgcgaagtcggatgtgaggtacaggtttgtgatcgatgtggccagctccttgtcgcagtagatatatggtgatgcgtcctgaatatttcatctgccattatcgaggactttttattagaataaaggggaacttgccggtgcgaagaatttgcgctcttccttctccgcagtttggcttagcttgattaaatgtactagttctgctttcttgtgtgattactttcgcttgttcaatcatctttgatattctgctggatttggggagagctgtatcagttggtcagggacttctcccaggtcggccatcttcccctagattcagcagaagaacatatattcggtttggcatttacatcagccagaaagtattgaatttcctgcttaaacaaaggatattgttgccaaattaaaattttagaggcaacatgtcaaaaaaaaaa

SEQ ID NO: 148 - DNA, 1337 bp, Eucalyptus grandis
gagagaaaccggaaaagcaataccataaaagagagagagagagagagagagatgagcagctcgcaggtgataacatgcaaaggggtggtatgctggggagcaggggaagagtggaaggtggaggagatacaagtggatccccccaaggggagtgaagtgaggatgaagatgttgttcgccagtgtttgccacacggatgtcttgtgctcccggggtttccctttcccgatataccctcgagttcttggccatgaaggtgttgggattgtggaaagtgttggagaggaagtaaaagagttgaagaaaggagacgtggttattcctgtctttgtgggagaatgcggggagtgtgagaactgtaactcggagaagacaaacttatgcctccggcatccgctctcttttagtggcttattaccagatggcacatcgagaatgtccatccgaggccagaccctgtaccacctcctctcttgctccacctggtctgagtacacagtgtctgatgtcaactatgttatgaaggttgacccagatgtagctctcccgcatgctagcttcttgtcgtgcggattctccactgggtttggagccgcttggatggactccaaggtcgagagtggctcctccgtggctgtgatcggcctcggtgctgttggactcggggtcgtaaaaggagcaagggtgcaaggggccactaccataatcggcgtggacaaaaacgggatgaagaaagacaagggagaagcgtttgggatgactaatttcataaatccagaagctcaacagtcctccggtaatgcggattcgaaatccatctccgaaatggtcaaagacttgacgggtggagtcggcgtggactactgctttgaatgctcgggagtacctgacttgatcaaccaagcactagaagccactaaagtgggaaaaggcaaagcagtggtagtgggtgcagggctggaccagtttgtgcagattagtttcctgaatctgttgatggggagaacattgaagggaaccatttttggaggtctcaaaagcaagacccaccttcccctcctcctccacaaatgcaaaaataaggagatcctacttgatgaacttctaacccacgagatgaaattggaggacgtaccgaaagctcttgacatactgaagcagtcaaattgcgtcaagattttgatcaaaatttgacgccccatatgcctattgcctccttccctttctttcttgagtttgtccagtacgatattgaccttgctttgagttactttttttttttcttgtgaaattccaataatatataatcaatcgatggatccaacagaaaaaaaaaa

SEQ ID NO: 149 - DNA, 1480 bp, Eucalyptus grandis
tcacgagaaaacaagaagaagagaaaatccttccattgcatcggggaaaaaatggcgaagtcgccggagcaagagcacccgcaggcggctttcggctgggctgcgagagacccctccggcctcctgtctcccttcaaattctcccgcaggacaacgggagagaaagacgtgaagttcaaggtgtttttctgcggaatctgccacagcgacctccacagcgtgaggaacgagtggggattctcgacttatcctcttgttcccgggcacgagattgtgggcgaagttgttgaggttgggagcaaggtggagaagttcaaggcgggagacaaagtgggagtgggttgcctggtcggatcgtgcggctcctgcgatagttgccacgaccaactcgagaattactgccccaaaatgattctgacttatggtgccatgtaccatgatgggacgatgacccacggaggatactccaacatgatggtggtggatgagcacttcgccatcaaattcccgcaaaacatgcctctcgatgccggcgctcctttgctttgtgccgggatcactgtttatagcccaatgaagttctttgggctcgaccacccagggatccacttgggcctggtgggtctcggtggactgggccatgttgcagtaaaatttgcgaaggcgatgggggtcaaggtgaccgtgatcagctcctctcccgggaagagggaggaagcgctccagcgtctcggcgccgatgcattccttattagcagcgacaccaatcaagttcaggctgcaatgggcacaatggatggtataatcgacacggtttcggctgtgcacccgatattgcctttgattggtttgctcaaacagaacggaaagcttgttctcgttggagctcctgatcggcctctcgagttacccgttttcccattgatctttgggaggaagattgtggctgggagttgcattggtggaatacaagaaactcaagagatgattgattttgcagcaaagcacaagattaccgccgatattgaggtcatttctatcgactatgtgaacacagcaatggaccgccttgccaagggcgatgtcaagtaccggtttgtgatagatattggcaacaccttaaaagaagcatgaggctccagagactctgattagattgcctatgatggtgtcaagtaaaaattttggtgtccaaataaaaatttggctgggagattaaggccgattgtctggctcagtttgtttgtcacagatcttgaagcatattcaggaagattatagtttggcaggtgcattgaacatcatcgaacatgcatgatggtccgtatgtgtgtaattctctgcagtaagaatccattagtaagtgagaacgttcctgttttgaactttggagtgtgtggaagatgcacattttggttctacaccccgcttgctagcgcagttccaagatactgatacgctttcttcgtcaaaaaaaaaa

SEQ ID NO: 150 - DNA, 1295 bp, Eucalyptus grandis
accgacgcagagtacggcacttagtcacggggttttagttgtaatagcgagggatccgaggtgaggaagcatcctcggcagcactgccgttattagggttcgacgtgtctctctctctctgatcgtccgatggctcaagagactcagaaccacacgctctcggtgtccggctggactgcctacgactcctccggcgagatcaaaccctacaccttcaaacgcagagagaatggcgtgaacgatgtgacgatcaaggtcttgtactgtggaatttgccacaccgatctccactatgccaagaacgactggggcatcaccatgtaccctgttgtccctgggcatgaaataacgggggtggtgattaaggtgggatgcaacgcgggcaagttcaagatcggggaccgtgtcgggttgggctgcctggcggcctcctgcctcaagtgcgagttctgtgccgactcccaggagaactactgcgaccagatgcagttcacgtacaacggcatcttccgggacggctccatcacctatggtggctactccaacgtcatcgtcgccgattaccgatatgtggtgcgcatacccgagaacttacccatggactcggtggcaccactgctgtgcgcgggaatcacggtgttcagcccgctgaaggacaacggcatgctgggctcgccgggtaagaagatgggggtggtggggctcggcgggcttggccacgtggcggttaagttcgggaaggcgttcggccaccatgtcacggtcctcagcacatccccatcgaaagagacagaggcaaaggggcgcttgggtgctgatgacttcattgtcagcaccaattctcagcaaatgcaggccgggaagaggagcctggatttcattttggacacggtatcggctcagcactctcttgggcccatcctggagttgctcaaagtggatggaactttggtcatggtgggtgcacctgatcagcccctcgaattgccttccttccctctaattttcggtaaaaggagtgtcaaaggtagcatgacaggagggatgagagatacgcaggagatgatggatttgtgcggcaaacacaacatcacttgtgacgtcgaggtcatcgccccagacacaatcaatgaggccatggaccgccttgccaagaacgatgtgagataccggttcgtgatcgacatcgctgggaggatatcgaatatttgaagatggtgtgagccaggcttggggcttatcggatacaaatcactactcccataattgcagacactatttatctaaaaaaaaaa

SEQ ID NO: 151 - DNA, 1364 bp, Eucalyptus grandis
tcgacgtgtctctctctctctgatcgtccgatggctcaagagactcagaaccacacgctctcggtgtccggctgggctgcctacgactcctccggcgagatcaaaccctacaccttcaaacgcagagagaatggcgtgaacgatgtgacgatcaaggtcttgtactgtggaatttgccacaccgatctccactatgccaagaacgactggggcatcaccatgtaccctgttgtccctgggcatgaaataacgggggtggtgattaaggtgggatgcaacgcgggcaagttcaagatcggggaccgtgttggggtgggctgcctggcggcctcctgcctcaagtgcgagttctgtgccgactcccaggagaactactgcgaccagatgcagttcacgtacaacggcatcttctgggacggctccatcacctatggtggctactccaacgtcatcgtcgccgattaccgatatgtggtgcgcatacccgagaacttacccatggactcggtggcaccactgctgtgcgcaggaatcacggtgttcagcccgctgaaggacaacggcatgctgggctcgccgggtaagaagatgggggtggtggggctcggcgggcttggccacgtggcggttaagttcgggaaggcgttcggccaccatgtcacggtcctcagcacatccccatcgaaagagacagaggcaaaggggcgcttgggtgctgatgacttcattgtcagcaccaattctcagcaaatgcaggccgggaagaggagcctggatttcattttggacacggtatcggctcagcactctcttgggcccatcctggagttgctcaaagtggatggaactttggtcatggtgggtgcacctgatcagcccctcgaattgccttccttccctctaattttcggtaaaaggagtgtcaaaggtagcatgacaggagggatgagagatacgcaggagatgatggatttgtgcggcaaacacaacatcacttgtgacgtcgaggtcatcgccccagacacgatcaatgaggccatggaccgccttgccaagaacgatgtgagataccggttcgtgatcgacatcgctgggaggatatcgaatatttgaagatggtgtgagccaggcttggggcttatcggatacaaatcactactcccataattgcagacactatttatctatatttgtctttgtcatctgttggcctttcagtcgtaatcattcacctcatcctagtcattcatcctacacttttagagcttatattgcaacaagcccttgtccgattttcataagaaacaataaaaaagaaatgacaagaaatgaaataaagcttcgcaagttctataaaaaaaaaa

SEQ ID NO: 152 - DNA, 1876 bp, Eucalyptus grandis
gcacaagcacacacaaacacgccattcctcttaccgctccaaaggaaaaaagaaaaagaaaggaagaggataagggaggaggagaaaggaatggggtctgatgcagaatcactggttcacgtgctcttggtctccttccccggccaaggccacgtcaacccgctgctccggctcggcaagcgcctcgcctccaagggcctcctcgtcacgttcaccacccccgagagcatcggcaagcagatgcgcaaggccagcaacatcggagacgagcccgcccccgtcggcgacggcttcatccggttcgagttcttcgaggacgggtgggacgaggacgagccgcggcgccaggacctcgaccagtacctgccccagctcgagaaggtcggcaaggtgctcatccccgagatgatccgccgcaacgccgagcgcaaccgccccatctcatgcctcatcaacaaccccttcatcccgtgggtctccgacgtggccgagagcctcggcctcccctcggcgatgctctgggtccagtcctgcgcgtgcttcgccgcttattaccactactaccacggccttgtcccgttcccgagcgagtcggcgatggagatcgacgtgcggctcccgtgcatgccgctcctcaagcacgacgaggtcccgagcttcctctacccaacatccccgtaccctttcctccgtcgggcaatcctcggacagtacaagaaccttgacaagcccttctgtatattgatggacacgtttcaggagctcgagcttgagataatcgagtacatgtccaagatatgcccgattaagacagtcgggccgctgttcaagaacccgaaggtcccaaatgcgaatgtgcgtggggacttcatgaaggctgatgactgcgtcgggtggctcgactctaagcctgcggggtcggtggtgtatgtctcgttcggtagcgtggtgtacctgaagcaggaccagtgggacgagatcgcgtacgggctgttgaactccaacgtgaacttcttgtgggtgatgaagccgccgcacaaggactccggctacaccgtgctgacgctgcccgaggggttcctggagaaggctggcgataaggggaaggtggtgcagtggagcccccaggagcaggtgctggcccacccggcggtggcggccttcgtgacgcactgtggatggaactcgtcgatggaggcgctcgcgtcggggatgccggtcatcgccttcccgcagtggggggaccaggtgaccgacgccaaatacctggtggacgtgttcaaggtcggggtccggatgtgccgcggcgaggcggaggacaagctcatcacgcgggacgtggtggagaagtgcctgctcgaggcgacggtcggggagaaggcggcggagatgaagaggaacgcactgaagtggaaggcggcggcggaggcagccgtggcggagggagggtcctcggacaggaacatacaagcgttcatggacgaggtcaagaggaggagcgtggaggtggcgctcgccaagggcagcaagtcgacggtggttgaagctccagcggcggtcagagaaggagcagcgaccaatggaaaggtcgagctggactcctcctaaagggaggacgacgtgacgtggcaagcatcgacacgtggatgagttgattagaaggtccgacccaaatcggacatagttacattgtggggaaagtaagtggaattaatttgagtataaatcagacctgatgctttagttttgggaataaatcatgctatggatagaatagggcgggacggtctcatattttggttcaatgttctcgaaatcttgtagcaatttgtaatctaatctaattttatacgttcctcctattccaaaaaaaaaa

SEQ ID NO: 153 - DNA, 1840 bp, Eucalyptus grandis
cttcaaactctctctctccctccctccctccctctctcgctcacacatacacacataaacctatactacatcgtttcacttctctcttcccgagctcagaaacgatatggggtcggaggcgctcgtccacgtcctcttggtctcgttccccggccagggccacgtcaacccgctcctgaggctcggcaagcgcctcgcctccaagggcctgcttgtcaccttcacaaccccagagagcatcgggaaggcgatgcgcaaggcaagcaacatcggtgaggagctctccccggtcggtgatggcttcatccggtttgagttcttcgaggacgggtgggacgaggacgagatacgccgccaggacctcgatcagtacctcccccagctcgagaaggttgggaaggtcctcatccctgagatgatccggcgcaacgccgagcaaggccgccctatctcttgcctcatcaacaatcctttcatcccctgggtctccgatgtcgccgatagcctcggcctcccctcagcgatgctctgggtgcaatcctgtgcatgcttcacttcgtactactactactaccatggcctggtccccttcccgtctgagacagcgatggagatcgatgtgcaactcccttgcatgccgctcctaaagcacgacgaggtcccgagcttcttgtacccaacgaccccgtaccctttcctccggcgggcgatcatggggcagtacaagaacttggacaagccattctgcatcctgatggacacgttccaggagctcgagcatgagatcattgagtacatgtccaagatcagccccatcaagacagtcgggccgctcttcaagaaccctaaggccccgaacgccactgtcaagggcgatttcatgaaggctgacgactgcgtcggctggctcgactcaaagcctgcttcctcgatcgtttacgtgtcgtttgggagcgtcgtgtacttgaagcaagaccagtgggatgagattgcttatgggctgttgaactccggggtcaacttcttgtgggtcatgaagcctccacacaaggactctggctatgaggttctcaaaatgcctgaagggttcttggagaaggctggtgataggggcaaggtggtgcagtggagcccgcaagagcaagtcctggctcacccctcggtggcctgcttcgtcacgcactgcggttggaactcgaccatggaggccttgacctctggcatgcctgtggtggcgttcccgcagtggggtgaccaggtcaccgacgccaagtacctagtggacgtgttcaaggtcggggtgaggatgtgccggggcgaggcagagaacaagctgatcacgcgggacgtggtcgagcagtgcctccgcgaggcaacctcggggcccaaggccgaggagatgaagcagaacgcgatgaagtggagcgcggcggcggaggcagccgtggcggagggcggctcctctgaccggaacatccaggccttcgtggacgaggtgaagaggaggagcctggaggtgctggccgtgagcggcaagtcaacggccaatggcgttgcggagctgggcgagccaaaggtcaacggggagctgaaggtagtgtcgtgaggtgtggagatgagaaattcaggtgtgtctcgttttggagtgtagattgtaaggtgtaagctaatttgggtaggcgtgggaataaatttgggtttgtccaagatggagtctgggttttgttacctgaatttttattttttttgttaattgtttttgtttttctatataaatatcataaatgagctgaggatccttcatgggatcctgtgcttcttttggcttccaaaaaaaaaa

SEQ ID NO: 154 - DNA, 1840 bp, Eucalyptus grandis; identical to SEQ ID NO: 153

SEQ ID NO: 155 - DNA, 1840 bp, Eucalyptus grandis; identical to SEQ ID NO: 153

SEQ ID NO: 156 - DNA, 1840 bp, Eucalyptus grandis; identical to SEQ ID NO: 153

SEQ ID NO: 157 - DNA, 1840 bp, Eucalyptus grandis; identical to SEQ ID NO: 153

SEQ ID NO: 158 - DNA, 1680 bp, Eucalyptus grandis
cggcaggcgggcggctgcgtggcagttgttcatggctcaggcggaggagaagagagaagagaatcatgtccttttggtggccttctcttctcagggccatatcaacccgatgctaaggcttggcaagcgtctcgccgccagaggcatccatgtcagccttgccaccaccgagatcgttcgccaccgcatgcttaagtcctctggtgccggtcccgctgaccatgtgaccggtatcgagctcctgttcttctccgacggcctgagccttgactacgaccggaagaccaacctcgacgtctacatggacatcctaggtaaacaagggcctagcaatctctcggctctaatcaaagaacattacacgagtccgaagaagctcttatgcctagtcacgaaccctttcgtgccctgggtttccgatgtagccgccgagtacaacatcccttgtgccatgctatggattcaaccgtgtgcgttgtacgcgatttactatcgctgcttcaataagctcagcgccttcccgactctgacagaccctgatatggttgtggagctgccgggtttaccttcgatggagaaggaggatctgccatcctttgtgctccccaacaacccatttggcagcttccccaaattattctctgaactattccaaggcatggagaaattcaaatgggttttagggaattctttctatgagcttgaaaaacatgtcatagactcgatgtgcgagctttatccgataaggccaatcggtccactagtccctccaacgttgctaggccaagatcaagaacttgaggatgcaagtgtggatatgtggaaatcagatgacacttgcattgaatggttgacgcagcaacctccaagctcagtcatctatgtatcctttgggagcatagttgtgttaccagccaagcaaatggaagcgatagccatggctctaaagaacgtgaagcgcccgtttctttgggtggtgaagccgcctgaattcccgacgcctgatggcgcagggcaacttccatcatggtttctcgaagaaaccaaagaccaaggtcaagtcgtgcgctggtctcctcaaactagagttttgtcacacccggctgtggcatgtttcatcactcactgtggatggaattccatgctcgagactatttgctcgggtatccctctcatagcctacccacagtggactgaccagccgaccaacgcaaagctcattgtcgatgtctttaagattggcgtgaggatcaagaaggaagctgatggaaatataaggggtgaagtgattgagaaatgcatcgaagaggtcatggttgggccagtagctgagcagttgagaaaaaacgcgatggcactaaaggccgaggctcagaaggcggtggcggcaggtggatcatccgatgagaatattcggctcttcgtggaggaaattaccggcgactcttgcaagaaggatggttccccaaacgtaggaaatttgagccatgaagtccaagataaggttagtgataaaggtgtgtagggagaaacgtgttcggattggccgctaagagattgtggcttgtcttcttcacataaaagacaagacattattgtcctagaagacaagtatgatatgaaggttgtggtgttcctgcgcttggaaaaataaagaggacaattccaataaaaaaaaaa

SEQ ID NO: 159 - DNA, 1806 bp, Eucalyptus grandis
actcgctaaatgtcccgcatccatataccccatacctcctgtcgagtgttgccttagcgtcatcgctatttcgaaataatttcttcaagcctcgtccatggcacctccacacttcctcctcgtgaccttccctggccaaggccacataaacccttccctccaattcgccaagcgtctcgtgcgtgtcggcgcccacgtgaccttcgccactgccattcgtgcccgtccccgcatggctgagtcggaatctatccccgaggggctatccttcgccagcttctctgatggctacgacgacggtttcgacaattgggatgaaatggaggaatacatggacaagatcaagcgacgaggaacagagactttaagtgacctcatcgcctcgaaccttaagagcggtcggcgattctcaggtgtactctacactatcctccttccgtgggctgccgaggtcgctcgttctcatggcattccttcgacattcgtttggattcaaccggccactgttttggacttctactattattacttccatggctacggcgatcttattcgaagcacgggcggcaatccttcggtgccaatccaattgccagggttgccgcctctcatggcctgcgacataccctccttttttaattctaaaaatgagtacaacttcagtctcccgcttttccaatggcatttcaagatactacttgaggaggccaagccaaggattctggcaaacaccttcgatgcgctggaaccggatgccatacgggctatcaatgagttcgaggtgattgggatcgggccgctgatcccgtccgcgtttttggacggccaagatccatcagacacttccttcggaggcgatctcttcaagagctcgagcggctacatggagtggctggacacgaagccaaaggcgtcggtgatctacgtgtcgtttgggagcatctccgtgctatcgaagccacagaaggaggaaatggcacgggcgcttgtagaggctggccggccgttcttgtgggtcatccgggaaagcgggaaagaagagagagacgaggatagattgagcttcaaagaagaactagataagatagggatgatagtgccgtggtgctcgcaagtggaggttctctcgcacccttcagtggcgtgtttcgtgacacactgcgggtggaactccacgtcagagagcttggtctgcggggtacccatggtggcgttcccgcagtggagcgatcagcaaacgaacgcgaagctcgtggcggatgtgtggaggaccggggtgaggataacgcccaacgagcaaggcctggtggagagcggcgagatgaggaggtgcttggagctggtgatgggagatggaaaggagggggaggagatgagaaggaatgcccggaagtttagggatctggcgagggaggccgtgaaggaaggcgggtcatcggacaagaacctcagggccttcgtggacgaggtcagagaagcgtctgagctcgaatgaatcgtctatggtgtcgctgtgagcagctaacgtggtgctttcctgtcctcatctttagggacttttagcgaatgcatattttatatggcttttatgtaatccttcctgtgggcatgcagtcgtcgcttattgttcaggacaaattattgtcctttctaggtgacattttttcttttcttattttccattcctcctatttcagcccgtcatatatgacgcttatgttgctaggtcttgaatcttgttgcttggtcttgaatctcgatggttcgacctacagctgatggtaaaaacatttctcaaaaaaaaaa

SEQ ID NO: 160 - DNA, 1648 bp, Eucalyptus grandis
atggacgagaatagaaagagagattggaatcggcatctggtccttgttccctgtcctctccaagggcacttgaacccaatgctcagtctagccagcgttttccactccaagggtttcggggtaaccctagttctcgtgcaaacgtcctctcatcccgccgccacttcttgggcatccgacgacttcttctatgaatcgctgggtggatctgatggcagtatctcgaatgctcccgacgtggatctcatgcgctttctgaacgaggttaacttgaagtgtaaatcgtcgtttcgagattgcttaatgggattgcgaatgggtcgactgagagatcgtaaactatgtgttgtgtatgatgctatcatgtatttttcagcagaagttagcgacgaattggagatcccaaggatggtcctgaggactagcattgtagctaattttcttggcctttcaatgctcagtcagaaggcctaccttccagctcaagaagatggagcggtgaaggccatccaagagctgatcccgtcgatgagagcgagggacatgcctgtgttcgacaagtcctgcccagaagccacggagcgagtcctcgcccagatccatgaatccacaagcacagcctcagcaatcgtatggaacacgctgcagactctggagcaggccctcctccaccgcctccagtcctctctctcccctcccatcttccccatcggccctctccacaagtaccgaacccgggatcctcgtcgtcgtcaccatcgctctctcttcgccgtcgagaccggtgctcgtcgcgaggaagatcgcatcaagtgcgtgtccttcctggactcccaccccccgggctctgtcgtctacgtgagcaccgggagcctcgtcaagctgagccggtccgagctggccgagatggcccggggcctcgccgactgcggccagcccttcctgtgggcggtggagctgagctcggcgcacgatggtgacatcgcacagctcatcccaagaggggaagagctgctgtgcgctgctgcagactgtcatcctaatgccccttcgatgcgggggctcgtggttgcgtgggcgccgcaggaggaagtgttggcacacgggtcgatcgggtgcttttggacgcacaacgggtggaactcgaccctagagagcatgaccgagggggtgccgatgctgtgttggcctagggttggggaccagaagatcatcgccgggttcgtgacccgggtctggagggtgggcttggagctggagtgcgatggcaatggagggttagagagagggaggatctcgaggtccattaagcggttgatggcgggcgaggaagggagggagatcaggaagagggcgttggagatggaggagacggtggagctcgctttgagcgatggcggttgctcttctcagtccctgagcaagctggtggatttcatccagctgctctaaatgacattattttgtccatcaataagcgctttcgctaggcaaatgtgccctcaattccgagatgaagaagtcgaaatagatcgtgaatttacatacatgatcattattctatgtctatcgttgtatctaaacagatggtgtagatggtgttggttcatatgatctatcatatcatataataatttcaaaaaaaaaa

SEQ ID NO: 161 - DNA, 1999 bp, Eucalyptus grandis
gcgggaatggcgccgtctccgtccaccgccttcagcattcgccttctggcgttcgcgctcccgttcgcgctcctcctcggcaacgctgttctccgggctcaagccagcgtccattactacgacttcgtgctgagggagacgaatatcacgaggaactgtacttcctggagactgttgttagtgaacgatagcttccccggaccgacgattgaggttcataaaggtgatctcgtgttcgtgaatgttcataatcaaggagattacggagtcacacttcactggcatggcgtaaagcaacctcgtaatccatggtcagatggtccagaatacattactcaatgtccaatcccaccaggcacaaattttacgtatgaggtgaattttactactgaagaaggaactctttggtggcatgcccatagtgtctggacaagagccactgtgcatggtgcaatagtcattctaccagaagaaggaacaacctacccttttcctaagccagatggcgaagaaatcattgtgcttggttcttggtattcggaaggagatgatttgaattctggcgtaggcgtgagcctggagacgggtgaagctatgcctgaatcgattggttatatgataaatggagagtttggagattttgttgcctgctcacaagattcgacatatcacatgtacgtcgaatatggcaagacctaccttcttcgtataatcaatgccgttgtcggtgctgagctcttctttgccatcgctgaccacaacttgacggttgtcggtatggatgcatcgtacactggacctctagtgagtccgtacttgacaacgagccctgggtcaaccctcgacgtaattttcactgccaataagaccccaggaaggtattacatggctgtccgccgctacacgagccaggacacggacgtaacggatttcaaccacatggtcgccactgccatactccactatagcgggaactatagtctcgacacatcaccgaaattccccaatcgctctctcccgggatattatgactatagtggggcagataccttcacattcaagctccgaggtttggcaagtaaagaacatccttcggatgtgcctctcaacataacgaggaggatgttcatcacgctctcgatgaacgagattttgtgcccgcatcatgattgtatcgttgctccgaccacgctcggctcaagtctaaataaccaaagttgggatgacccatctacggatgtgctccaagcatattacaagaacatcagtggagtatatacggcagattttccggattttcctccttttgcctataactggacgggagccgataatccggacgcatggggagtggcgaacaaggtgaccagagtgaagatgttggagtacaatgaatccgtggaggtagtgttccaagacagcggcgtcttgcaaggcgcacagcgtcatccgatgcatatgcacggatacagtttctatgtcgtgggacacggccttggcaacttcgacaatgagacggatcccctggagtacaatctgctcgacccacccctagtcaatacgttctccgttcctagggacggatggattgccatcagatttgtggccaataatccaggcgtatggttttggcattgccacatagataaacacatgagctggggcatggacacggtcttcatagtaaaagatggaggcactgaggaaacgagcatgcgagggcctccttcgtacatgcctccttgtgaagattcctacaacattgccaggatgaaatcccgtcgtctcccccgtcaaatctctcgcatatgagaccacatgcagcctctcgaagctgagcagggtttcaaagtcatatagcgaacagccttgtacgtagcataagttccgtccccctcagatttttcttgtgggagtcgttgatctaagaatttgtagcaattgtgaacgctggattatatagagtaatgtgatacctaaattttttttaaaaaaaaaa

SEQ ID NO: 162 - DNA, 2091 bp, Eucalyptus grandis
tcgggttctttgtacaacttaatcggttgtatgtggatacagtgcagaaactgcccacgaattcagaatcaaatattatgagatgctccacagttccccggtttaagtaccttcccatcagtgtacctgcattgtcttcaaggaggacatctaaagcaactactgtaagactttggaccggcacgagcacaagtctccttctttgttctggatcaagtgattgttacaagttcatttttctcttgttgagagagagagagagatgggaacatttctagggtttgtggtcaccatgaccctgctcttttgcatggctcaaggcgaagtcatctactatgatttcgtggtgaaggagacacctattcagatgttatgtgggacgaatcagaccgtattgactgtgaatggtctgtttcctgggccagagattcatgctcacaaaggcgacaccatctacgttaatgtcaccaacacaggaccttatggagtcactattcattggcatggagtgagacaaataagatatccctggtccgacggcccggagtacatcacacaatgcccaatccctacaaactcaagtttccttcaaaaaatcatactcactgaagaagagggcacactatggtggcacgctcatagtgactggacacgtgccactatacacggccctataatcattttgcctgtcaacggcaccaactacccttacaagtttgacgaacaacacacaatcgtgatatctgaatggtatgcaagagatacaaaggacataattgatgaggctctcgcaaccggaggtgatccagatttgtctgtggcctataccatcaatggtcaaccaggagatagttattcatgctcaaatgattcgacgtacaatttaacggctgtgcaaggaaaaacatatctcctccgcatcatccattctgggttgaacgaagagatgtttttcggcatagccgaccacaatattactgtggtcggaatggacggagcttatttaaagccgcttaatactgagtacctcatgataactcccggtcaaacaatggatgttttggtcactgcaaaccaaacccccggtcgctattatatggtttttagtccgttcgtcgacaccaatgccccgtccaatgacaatgtcactagggggatattccaatacaccggcacttataaccaatcagagactccggtattacccgagcttccaggtttgaccaataagagtgatgccggaaacttcaccattcagttgaggagtttgaatagtgcagaacatccgtccacagttccgaccaacatcactaggaacattacgatcacggtgtccgtgaatcagcagccatgtcctgctaatcaaacatgtaacggtccagatggctcaatgcattcagcaagcttgaacaacattagtttttcggctccctcaatcagcattctccaagcatactacaacaatctccaaggagtctacaacaaaacttttccggatacaccacctttcgtgttcgactataccgggaatgtatcggccttaggggaagctgccaatgtgactaccgaagtgttgatgattaaccataatgaggaggtcgaaataagattccaagggaccaatctcggagcagcggagaatcaccccatgcatttgcacggctatagcttttatgtcgtcgggatgggcgacggaaatttcagcgactcctatgtatcgcagtataatacagttgatccgcctttcgttaacaccgtcggactccccaaaaatgggtggacagcaatcagattcaaagccgataatccaggggtgtggttcatgcactgtcacttagaacgccatgcgagctggggaatggacacagtcatcgtcgtcaaagatgggccgaacgatgatcagaaggtgcttccaccgcccgacgacgtgcctccttgctcgtaatcaggatgttgtttgcttctagtccttaggacaaaagctattgatatcacactgggaataaaccatctgaatgttgtgtcgaagtttgcaatgcggcatcattctaataagtttcaattgtaacacttgtgtcggcaaaaaaaaaa

SEQ ID NO: 163 - DNA, 1963 bp, Eucalyptus grandis
gcacaagccaagtctcctctttacttctggatcgagtgattagtacaagttccattttgtatcagggagagagagggaccatgggaacatttctagggttcgcggtcactgcgaccctgctcttctgcatggctcaaggcgaagtcctcttctatgattttgtggtaaatgagacaccgattgagatgctatgtgagacaaatcggagtgtactaatcgtgaacggtctatttcctgggccggagatccgtgctcacaagggcgacactatttacgttaatgtcaccaacttaggaccttatggaatcactattcactggcatggagtgaggcaaatacggtatccttggtccgatggcccagaatatgtcacgcaatgccccatccctacgaactcaagctttcttcagaaaatcaaactcaccgaggaagagggcacgctatggtggcatgcccacagcgattggtcacgtgccacaatacatggtcctataatcattttgccagtcaacgacaccaactacccttataagtttgacgagcaacacacaatagtgatttctgaatggtatgcaagagatacgaaggacataatcgatgaggctcttgaatctggaggtgatccagacttgtccgtggcctataccatcaatggtcaaccgggagatagttattcatgctctaatggttcggcgtacaatataacggttgtgcaaggaaaaacatatctcctccggatcatccactctgggttgaatgaagagatgttcttcggcatagctgagcacaatctcactgtggttggaatggatggagcttatttaaagccacttaatattgagtacctcatgataactcctggtcaaacgatggatgttttggtcactgcaaaccaaatcctcggtcgttactatatggtttttagtccgttcgtggacacaagtgccccatccaacgaaaatgtcacaagaggaatattccaatacaacggcacttataaccactcagagactcctgtgttacctgaacttccgggttttaccaataagagtgatgccggaaactttactattcagttgaggagtttgaatagcgaagaacatccatccacggttccaaccaacatcacaagaaacattacgatcacagtgtccgtgaatcagcagccttgtcctgctaatcaaacatgtaccggtccagacgggtctatgcattcggcaagcttgaacaacataagttttttggctccctcgattagcattctccaagcatactacaacaatcttctaggagtctacaacgaaacttttccggatgaaccatctttcgtgtttgactacactgggaatgtatcggccttaggggaagctgccattgtgggtaaggaagtgttaatgattaactataatgaggaggtcgaaataagattccaagggaccaatttgggagcagcagagaatcacccaatgcatttacacggctatagcttttatgtcgttgggatgggcgatggaaatttcagcgactcctatgtatcggattataatctagtggatccgccctatgttaacaccgtcggactccccaaaaacgggtggacatcgatcagattcaaagctgataatccaggagtgtggttcatgcactgtcatttagaacgccatgcaagctggggaatgaacacagtcttcatcgtcggagacggcaaggaaaagcatcaaaaggtgtatccgcctcccagttacatgcctccttgtaccgtgtcttaatatggatgttgtttgctttgagttcattgccattgcaaaaggctgtagacatcccaatgggaataaatcatctgtattttgtaccgaattatgcacttttgcatcatttttaaaagtttcaattgtaacacatgtttggaatccaagaagttatttgattcaaaatattgtattttcgtctgataaaaaaaaaa

SEQ ID NO: 164 - DNA, 1963 bp, Eucalyptus grandis; identical to SEQ ID NO: 163

SEQ ID NO: 165 - DNA, 2124 bp, Eucalyptus grandis
catagttccaaagacaaacctgatcaaccagagagtgagaccacacagagagaaagagagagagagagagagagagagagagagagagagagagaatggagtcgtgctgggttcgtctccttgttcttctctttggggtgctcgttcttcctgcaatggtggagtgcagagttcgacactataagttcaatgtggtgatgaagaacatgacgagactatgctccaccaagcccatcgtcaccgtcaatgggaagttgccaggacccaccctctacgccagggaaggcgacaacgtgcttgtcaaggtcgccaaccacgtcaagtacaacgttactattcactggcatggtgttcgacagctcagaacgggctgggccgacgggccagcgtacattacccaatgcccgatccagacgggccaaaacttcatctacaacttcacgatcacggggcagagagggacgcttctctggcacgcgcacattctgtggctgagagtgaccctgcacggcgccatcgtcatcttgccgaagcgtggcgtcccctatcccttccccaaacccagcaaggaatatgttatcatcttggctgaatggtggaaagcggacaccgaaaccgtgatcaaccaagctatgagtcagggattggcgccaaatgtctcggatgctcacaccattaacggacatcccgggcctgtcccgggttgcccttcagaacgtagctatacgttgccggtggagagcggcaagacctatctgctgcggatagtcaatgctgcactcaatgaagagctcttcttcaagatcgcgcagcacaacctaaccgtggtggaagtcgatgccacgtatgtgaaaccgttccaaacggacaccatcctgattactccaggtcagaccacaaacgtcctcctcactacgaaccaaaacgccggcaagtacttgatcaccgcctccacattcatggaaacggccatcgtagccatcgacaacgtgaccgcaagcgcggccgtgcactattccggcaccctcgccagcgcctccacggtgctcaccaaaccgcctcctcaaaatgcctccgccgtggccaacagcttcaacaacgccctccggagcctcaactcgaagaagtacccggccaaggtcccaaagaccgtcgatcacaacctcttcttcaccatgggcttaggggtcaacccctgccccacttgcacagccgggaacggaagcagggtcgtggcggccgtaaacaatatctcattcgtgatgccgacgatcgccctcctacaagctcatgtcttcaacattagcggggtcttcacgaccgactttcctggtaaccctccgacgacatacaactacactgcgacgccgccgcagaacgcgagcgtgccgaccatgaacggcaccaaggtctaccggttgccgtataacgctacggtccagctcgttttacaggacaccgggataatcgcgccggagacccaccccatccatctgcacggattcaacttcttcggtgtgggcaaaggagtggggaattatgacccaaagaaggatcccaagaagttcaatctggttgacccagtggagaggaacaccattggaatcccatctggtggatggatagccatcagattcacagcagacaatccaggagtttggttcctgcactgccatctggaagtgcacacaacttggggactgaagatggcattcttggtggacaatgggaaggggcctaaagagaccctgcttccacctccaagtgatcttccaaaatgttgatcatttgatcatgaggacgacaagcgattactaatgacaccgagttagtggaatcttctctttgaaaaagaagaagaagagcaagaagaataagaaagatgaggagagaagccatagaagatttgaccaagaagagagagggcaataaaccaaagagacccttgagatcacgacatcccgcaattgtttctagagtaatagaaggatttactcgacactgctacaataaattaaggaagacaaggaatttggttttttccttggaggagtgtaatttgttttttggcaagctatacatgaatacatggaataaagaaagagaattttgagaaaaaaaaaa

SEQ ID NO: 166 - DNA, 2124 bp, Eucalyptus grandis; identical to SEQ ID NO: 165

SEQ ID NO: 167 - DNA, 1994 bp, Eucalyptus grandis
gctaaaaagatttcgtactgcaagagatggactcttggcttcaaatccttgttctcgttgcgtgcatcactccggctgtggtccagggcagagttcggaactacacattcaatgtggtaatgaagaatacgacgaggctgtgttcgagcaagcccatcgtgaccgtgaatgggatgttcccgggacccactctctacgctagggaagacgacaccgtgctcgtgagggtctccaaccgtgtcaaatacaatgtcaccatccattggtaagctcaaccgagctctaaattaaactactatctttaggaaatcgcacattaattttggtgtatatgcggttaggcatggtattcggcagctgaggtcggggtgggccgacgggccggcatacatcacccaatgcccaattcagccaggccaaagctatgtgtacaatttcaccatcacgggccaacggggcaccctcctttggcatgcgcacatactctggctcagggcaaccctgcacggagccattgtcatcttgcccaagcgcggtgttccataccctttccctaaaccccacaaggaagttgttgtcgtactgggcgaatggtggaaatctgatacagaagctgtgatcaagcaagccatcaagtccggattggcaccaaatgtctccgatgctcacacgatcaatggccatccagggccaatttccaattgcccttcccagggtggatttacattgcctgtcgagagtggcaagagatacatgcttcgaatcgtcaatgctgcactcaatgaggagctcttcttcaagatcgccgggcaccagctgaccatcgtggaggttgatgccacctacgtcaagcctttcaagaccgacacgattgtgatcgcgcctggccaaaccaccaacgccctcatctccgctgaccaaagctcaggcaagtacttggtcgcagcatccccttttatggactccccgatcaccgtggacaacatgaccgcaactgccacattacactactctggcacgctcgccgcgacttccacgaccctcaccaagactcccccacaaaacgccaccgctgtggccaacaatttcattaactctctccgaagcctcaactcgaagatataccctgccaaagtcccgcttacagttgatcacaacctccttttcacggttggactaggaatcaacccttgcccttcgtgcaaagctggcaacggaagcagagtcgtggcaagcatgaacaacgtgacgtttgtgatgccgacgacagcccttctccaagcacatttcttcaacataagcggcgtcttcacgagcgatttccccggtaacccgccgaccacttttaactacacagggtcaccgccaacaaatttgcggaccacgagtgggacaaaggtgtaccggttgcgttataactcaacagtccagctcgtgttacaagatactgggatcatcgccccggagaaccacccaattcatcttcacgggttcaatttcttcgcggtcgggaagggactgggaaattataatccaaaagtggatcagaagaacttcaatcttgtcgatcctgttgagaggaacacaataggagtaccgtctgggggttgggttgcaatcagattcagagcagataatcccggcgtttggttcatgcattgtcatctggaaattcacacaacctggggactcaagatggccttcttggtggacaatgggaaaggcccaaacgagtcgctgctaccgcctccaagcgatcttccgaagtgttgatccatgaggagaaattctatagtcaagtatgcagtagctcgagatgaagagtgatgagaaaagaaaatagacccttcccccaaaggaaaaggcttatacaggtggttttagcctagtaaaatgaagatccgaattgttttaaaagaattctttgttttgattgcaatattcgtattccgtaggaaatttctttaaagaacaagattctgccaaaaaaaaaa

SEQ ID NO: 168 - DNA, 1994 bp, Eucalyptus grandis; identical to SEQ ID NO: 167

SEQ ID NO: 169 - DNA, 1959 bp, Eucalyptus grandis
gcttgcttcgaattaagctaaaaagatttcgtactgcaagagatggactcttggcttcaaatccttgttctcgttgcgtgcatcactccggctgtggtccagggcagagttcggaactacacattcaatgtggtaatgaagaatacgacgaggctgtgttcgagcaagcccatcgtgaccgtgaatgggatgttcccgggacccactctctacgctagggaagacgacaccgtgctcgtgagggtctccaaccgtgtcaaatacaatgtcaccatccattggcatggtattcggcagctgaggtcggggtgggccgacgggccggcatacatcacccaatgcccaattcagccaggccaaagctatgtgtacaatttcaccatcacgggccaacggggcaccctcctttggcatgcgcacatactctggctcagggcaaccctgcacggagccattgtcatcttgcccaagcgcggtgttccataccctttccctaaaccccacaaggaagttgttgtcgtactgggcgaatggtggaaatctgatacagaagctgtgatcaagcaagccatcaagtccggattggcaccaaatgtctccgatgctcacacgatcaatggccatccagggccaatttccaattgcccttcccagggtggatttacattgcctgtcgagagtggcaagagatacatgcttcgaatcgtcaatgctgcactcaatgaggagctcttcttcaagatcgccgggcaccagctgaccatcgtggaggttgatgccacctacgtcaagcctttcaagaccgacacgattgtgatcgcgcctggccaaaccaccaacgccctcatctccgctgaccaaagctcaggcaagtacttggtcgcagcatccccttttatggactccccgatcaccgtggacaacatgaccgcaactgccacattacactactctggcacgctcgccgcgacttccacgaccctcaccaagactcccccacaaaacgccaccgctgtggccaacaatttcattaactctctccgaagcctcaactcgaagatataccctgccaaagtcccgcttacagttgatcacaacctccttttcacggttggactaggaatcaacccttgcccttcgtgcaaggctggcaacggaagcagagtcgtggcaagcatgaacaacgtgacgtttgtgatgccgacgacagcccttctccaagcacatttcttcaacataagcggcgtcttcacgagcgatttccccggtaacccgccgaccacttttaactacacagggtcaccgccaacaaatttgcggaccacgagtgggacaaaggtgtaccggttgcgttataactcaacagtccagctcgtgttacaagatactgggatcatcgccccggagaaccacccaattcatcttcacgggttcaatttcttcgcggtcgggaagggactgggaaattataatccaaaagtggatcagaagaacttcagtcttgttgatcctgttgagaggaacacaataggagtaccgtctgggggttgggttgcaatcagattcagagcagataatcccggcgtttggttcatgcattgtcatctggaaattcacacaacctggggactcaagatggccttcttggtggacaatgggaaaggcccaaacgagtcgctgctaccgcctccaagcgatcttccgaagtgttgatccatgaggagaaattctatagtcaagtatgcagtagctcgagatgaagagtgatgagaaaagaaaatagagccttaccacaaaggaaaaggcttatacaggtggttttagcctagtaaaatgaagatccgaattgttttaaaagaattctttgttttgattgcaatattcgtattccgtaggaaatttctttaaagaacaagattctgccatttgctaagttgcaaatttctgataaaaaaaaaa

SEQ ID NO: 170 - DNA, 2109 bp, Eucalyptus grandis
ggacagcctagctccagagcaaattcgagattcataaacatgaggtctttgtttctctcagctcttcttcttgcagtgatgagctgctttcttcctgaggttgcccatgcaggcattacgaggcactacacgttcaatatagagatgcatagtgagacccggctgtgccacaccaagaggatgataaccgtcaacgggaaattcccggggcctcgcatcgtcgccagagagggggaccgggtaatagtcaaggtggtcaaccatgtttccagcaacatcagcatccactggcatgggataaggcaacttcaaggtggatgggcagacgggccgtcatacattacgcagtgtccgattcagaccaaccaaagttacgtttacaacttcacaattacgggccaaagaggcaccctcttttggcatgctcacatctcatggctcagagcgaccgtctacggaccgctcatcatcttcccaaagcgcggtgttccttatccctttgctaaacccgacaaggaagtcccgatgctattcggagaatggtttaatgccgatacggaggccatcatcagccaggcgctccagaccggaggtggcccgaacgtctcggatgcctacactatcaacggaaagcccgggccgctatacaactgttcatcagatacattcaagctaaaggtgacgccagggaagacatatctcctccgccttatcaacgctgcactcaatgacgagctcttcttccgcatagccaaccattcgttcaccgtcgtcgaagccgatgcggtctacgtcaagcccttcaagaccgacatcctggtcatcgccccgggccagaccaccaacgtcctcctcaaggctaagcctaaccctcacaagagcacgtaccttatggcggcccggccatacttcacaggtcagggcactttcgacaatacaaccatggccggattcctcgagtacgtccagtcctccgggaatattactctccccaagaaccttaccctatctttaccgacactgcccgcgataaacgcgaccagcgtcgtcgccaatttcagccaaaagttccgccatttgaatagccggcaatacccggcccaagttccccagaccgtccaaaagaggtttttcttcacggtcggccttggaaacagcccctgctcaaagaaccaaacgtgccaaggacccaacgggaccaaatttgcggcgtcggtgaacaacgtctctttcgctctcccttccaccgcgctcctacagtcttacttcttcaaaaaatccaatggcgttttcaccaccgacttcccggccaccccattaaggccgttcaactacactggaacgccgccgaacaagacgttcgtcagcaatgggactaaggtggtggtcctcccattcaacacgagtgtcgagctcgtgatgcaaggcacgagtatcttgggcgcggagagccaccctcttcatctgcacgggttcaacttctacgtcgttgggcagggtttcgggaatttcaaccagagtacggatccagccaagttcaatctggtcgaccccgtggagaggaacaccgtgggcgtgccggcggccggttgggtggctatccgtttcctggccgataacccaggtgtttggttcatgcactgtcacttcgacgtccatttgagctggggcttaaagatggcgtggatcgtgcaggacgggaagctccccaaccagaagctccctcccccgccgtccgatcttccaaagtgttgacccctcctcctccgacccttcttgccccatcggctgttctgggttttacccccaccttttcgtttcgaacacttcaatcctgctgctttccccctaacttatcgtcactttccctgctcggtgtccgaggccaaattcggtatatgaggaatttacgtgtcgtgtcttctctgtctctctttctttttgtctgttttccttcgtggagtccgatgaattcgcattcatttaccacgggatagagtgaaattttagattcgagggaatttttgtatctagcaatggatgtgtcgatgcttcagttggagcctcagcaataatattactcttcatctaaaaaaaaaaaaaaaaaaa

SEQ ID NO: 171 - DNA, 2076 bp, Eucalyptus grandis
gcacgtatttcatcacttgcatttggccagcacatcatagctacctcttatagctgtaatcttcaccaaattggagagatgagcttccagaaccagctcttcatcttctgcacgttgctactagggtttctgaagttggcagaaggcaaaacgaggcactacaccttccatatcgattcccataacatgacgaggctgtgccacacgaggagtgtgctgagtgtaaacaagcagtatccagggccgccgcttgtggcgagggaaggcgacaacatcctcgtcaaggtggtgaatcatgttgccgccaacgtcacgattcactggcatggggttcggcaactgaggacgggatgggcggatggaccggcttacgtaacccagtgtcccatacagaccaaccagagctacacctacaacttcaccctcaccggccagagaggaacgctgctgtggcacgcgcacgtctcgtggctaagatcgagcatccacggccccatcatcatcctccccaagcggaacgagtcctacccgttcgagaaaccctccaaggaagtccccataatatttggagagtggtttaatgtagaccccgaagcggtcatcgcccaagctcttcagagtggaggaggtcccaatgtctccgatgcctataccatcaatggccttccaggacccttgtacaattgctcctctaaagacaccttcaagttgaaggtgaaacctgggaagacatacctcctccggctgatcaacgctgcactcaacgacgagctcttcttcagcatagccaaccacacagtcaccgtcgtcgaggttgatgccgtgtacaccaagcccttttctgcgggctgcctccacctaaccccgggccaaaccatgaatgtcctcctcaagacaaaaaccgactttcccaactccaccttcctcatggcagcgtggccctatttcaccggcatgggcactttcgacaattccaccgtcgccggaatccttgagtacgaacatccaaagagctcaaattacccgccgctcaagaagctcccccaatataaaccaactctccctcccatgaacagcaccggttttgtcgccaaatttacagggcaattgcgtagtttggccagcgctaagtttcctgccaacgtgccacaaaaggttgacagaaaattcttcttcaccgtcggccttgggaccagtccgtgccccaaaaacaccacgtgtcaaggaccaaatggcacgaaattcgccgcatcagtcaacaacatatcgtttgtgctgccgtccgtcgctctcctgcaggctcacttcttcggccagtccaacggagtgtacaccacagacttccccaccaacccgcccgtccagttcaactacacggggacgccgccaaacaataccatggtgaccaacggcaccaagacggtggtgttggcatacaacacaagtgtagagctggtgatgcaggacacgagcatcctcggcacggagagccacgcgcttcatctgcacgggttcaacttcttcgttgtcgggcaagggtccgggaactacaacccgaataaagacccgaccaaattcaatttggtggatccgatcgagaggaacacgttcggtgttccctcaggaggatgggtggccattcgtttcctagctgacaacccaggggtatggttcatgcactgccatttggacgtgcacacgagctggggtctgaagatggcatggatagtcctggacggaccacagcccaatcagaagttaccgccgccaccgtcggaccttccgaagtgctgactttgacagccacccaggacggtaaccgagccaccgcaaaaatgaagattttctccgccgagtgttcttccttttttttttggtaattatgtatcgtttgttggtataattcttttgtgtcattcttcttgatcatagcgaccctgccccttctttcaatgttggttgagaaagacagtacaacagctcaactgcgaccatgaatgcggtcgagtattttaatgatctctttatcaatcttaatcctcaactaccagaagtggtttcgcccgaaaaaaaaaa

SEQ ID NO: 172 - DNA, 2046 bp, Eucalyptus grandis
gtgaaacaccagacaaagagatcggccttggaaaagcagagaagaagatgagaacagggggggctggcaacaagatggccttgatcgctgctcttctgggcttcgtcttcttggaatacggctctcttctctgcatggctcgaggcaatgtccatcactacgatttcgtgctgaaggaaaccaacttcacgaggttgtgcacgaccaagagcatgctggtggtgaacgagagctggcccgggccggtgattcgggttcacaagggtgataccgtcttcgtcaccgtccacaacaagggcacctacggcgtcaccgtccactggcacggagtcaagcagcctaggaacccatggccggatggtcccgagaacattacccagtgcccaatcccggccggtacgagcttcactcaagaactttccttttccgacgaagaagggacgctctggtggcatgcccatagcgactggtcacgtgccacggtccacggtgccatcatcatatatccaaaacccggaaccacctacccttatcccatgccgtacaaggaagagctacttgttcttggcgaatggtataacggagatgtgatggccataatcgatgaggcacttgaaactggcggtgatccgaacgtgtcggatgcattcgccatcaatggtcaaccgggagatctatatgactgctctaatgcatcaacgtaccgcctattggtcaattatgggaagacgtaccttctccgcattgtcaatgcggtgatgaacgaagaaattttcttcggcatcgcgaaacacaaccttacggtggttggaatggatggagcgtatctaaaacccatcaaaaccgattacataatgataactcctggacaaaccatggacgttttggtcacggcgaaccaatctcctagccactactacatcatgggaagccctttcgcagatacaactgctccattcgacaacactagcacgacagcgatctttcagtatagtggcaactacactccgccgtcgaccccgtactctccatctctcccagcttatgatgacaaggatgccgcaggcaatttcacggtccgtttgaagagtttagcaagcaaacagcatcccattagcgtcccattgaaaatcacggagcggatcttcatgacagtttccgtcaatcaaatatattgcgcgaacgagtcatgtgatggtccggacggaaataggctatcggccagcttgaacaacatcagtttcgtgactcccacgattgacattttacaagcatattacaggcatatccatggagtgtataacagtacttttccgagcataccaccgtattttttcaacttcaccggcgacgtgggcaacaatacgatataccctagccaaggaacaaaagtgaagatgatcaaatacgggtcggttgtcgaaataattttccaaggaaccaacgtcggcgctgcggagaaccatccgatgcatctgcacggttacagcttctacgtggtgggagtgggcaatggaaatttcgacaataagactagtccaaagacatacaacttggtcgatccacccttggtcaacacgatcggacttcccaagaacggttggacgacaatcagattcgtcgcagataatccaggagtatggtttatgcactgtcacttagagcgacatgctagctggggcatggacacggttctcattgtcacggacggtctggctaacacgaacaaaatgcgcgggcagcccgcttatatgcctccttgtgccaagtcctaaggcaaagaatgaatttgcagcttacttttgagcttggcaagcgtgcttgttcttgattttgaataaaaagtcgacatgaccaaaaggattgggagcttgtgtgagaaatgttttggctacaaaactgcagtatatgcaatatatcgaattctctctctctctctctctcgctctctctcaagaaagcacaaggaaaggaactttgagtaagaagatgccatgtacccctgcgtgaaaatttaaagtatcgaattctctctcaaaaaaaaaa

SEQ ID NO: 173 - DNA, 1892 bp, Eucalyptus grandis
gttcgaaaccagtttaacagagcagccaccataacccgggtggccaagatgggttcttctccgtgcgagctccgatggcttctcgctctactgggtggactgctgttggtcctccccctggctcaaggcgaggaccattactacactttcgtcctgcgagacaccaacttcacgaggctgtgcacgacgaagagcatgtttacggtgaacgaaagcttcccggggccggtgatgtacgtccgtaagggagacacggcctacgtcaacgtcttcaacgaaggacactacggagtcaccattcactggcatggcattaagaatccaaggaacccatggttcgacgggcctgaatacgttacgcagtgtccgatccctccggggactaacttcacttaccaagtcttgttcacctcagaggagggaaccctttggtggcatgcacacagcgattggacccgcgccactgtccacggcgcaattgtcataaagcccgcccttggcaccacttatcctttcccagagcccgacgatgaaaaagtccttgtcttcgcatcctggtacgacgaggacgtgatggagttgatggaagaggccctttctgaaggtggactgacgacattgtcagatgcttactgcatcaatggccagcctggtgatttttataattgttccagagaaaacacgactagaatatccgtcgattatggcaagacctatcttctccgtctaatcaattcagtgcaaaataccgacatgtactttggcattgcaaaccacagcctaacggtggtaggatgggatggagcctacgtcaagcccttcgtcatgagttacatcatgataaccccgggccaggcgatggacattttggtcacagccgaccagccgctcggcgagtactacatcatcctctcaccttacttcgatggtcaagcggacgatttcgacatgagcatcgctagtgcgatcttccagtacaacggcaactactcttacaccggattgccggcgtatccgagtgatttccccggatgggaggatatagggcccgcgactgactttgtcaaacaactgagaagcttgaactcgctggagcaccccatcgatgtcccccaggacgacgagatcacgaccaggatgtacatcaccatctcgatcagcatgatgaaatgtccaaatgcctcgtgtgaaggaccagacggtaatcgcctcgcctccgcgttgaacaacatttcttttgcaaaccctgacctggatgtgcttcaagcatactacagcaatatcactgggtattacacgccggatttccctgatctgccacctacgttgttcaacttcacgtccgaagacctattgacagacaacgtgacaatgtcggaccaaggaacgagagtcaaggtactgaactacaacgagtctgtcgagataatcctccaagggaccaacgtgatgaactcaggcgagactcacccaatgcacctgcacgggttccggttctatgtgatcggaatgggccagggcaatttcgacaacaagaccgctccagaaacctacaacatgtacgacccacccgaagcgaacactgtcccagtgccgaaggacgggtgggctgtcatcagattcagggcagacaatcctggcgtatggtacatgcactgtcatttcgatcggcacatggcatggggcatggacacggtattcatagtcaagaatgggaccacggctgagacaagcatccgggagcctcctgcgtacatgcctccttgcgagacggactcgtcactgttgagcgcccttcattcttacttacggcagaaggcttaaataattctctatatgatgtagttgtcctgggaagtttttattcggaaacagagagactaaaaaaaaaa

SEQ ID NO: 174 - DNA, 2096 bp, Eucalyptus grandis
ggggcaagaccgaagaacacttactttcttttttctctgtgtttatggaaatgaggtgctcgggaggagttcagatacttcaaattctagggcttgtgctagtccttggcatccctaattgtgaagctgttcttcgccataagttcgtgatcaaggaaacaaactatacgaggctatgcagcacgaagagcatactaaccgtcaacggccaattccccggaccgactttatacgcacacaaaggtgatacggtcatcgtggatgtgtataacaaggccaattataacgttaccattcactggcacggtgtgaaacaaccaaggaatccttggcatgatggtcccgaatacatcacgcagtgcccaatcaaacctggagggaaattcacgcaaaatgtaacattctcacttgaggagggaacgctttggtggcatgctcacagtgactggacacgtgccaccgtccatggtgccattatcgtttatccaaagaaaagcacgagctatgcttttgctaagcctcatacagaagtgccaattatattaggggaatggtggaaacaagatatagtcgacatatatgatgagtttcttcaatctggaggagatccaaacatttcagatgcttatcttattaatggtcaaccgggcgatttgtatccatgctcaaaacaagatacgttcaagctggttgtggagtacggcaaaagctacctcctcagggtcatcaacgcggcgttgcaagacatcctcttcttcgcgatcgcaggtcaccaggtcacagtggttggcaccgatgcttcctacacgaagcccctgaaggtcgactacatcaccatctccccaggtcaaaccatcgaccttctcttggaggccaaccagcccaaggaccattactacatggctgctagggtttactcaagtgcaaccggcgttgagtttgacaacacgaccaccacggccctaatccaatacaaaggtcgatacacaccgtcctcgcctcctcctttaccttaccttccatactacaatgatacggctgcatcggtcaacttcaccggcaggctccggagcttagctagcggggaacacccggtccctatcaccgtcccgcaaaccgtgacccacaaattcctgttcaccgtctcagtgaacacgttcccttgcgtgaacgactcgtgtgccgggcccaacgggtcccgcctcgctgcaagcgtgaacaacataagctttgtgtccccgtcgatcagcatactccaagcctattactaccacatcaagggcgtgttcggcacccggttcccgagtaagcccccgctcgagtttaactatactgcagattacctcccactggccgtgaggacgccacgaaacgggacggaggtcaaggtgctcaagtacaatgcgacagtggagatggtctttcaggggaccaacgtggtggcggggaccgatcatcccatgcacctccatgggaccagcttttacgtggtggggtggggatttggcaatttcgacaaaaagaaggaccccaaaaaatataatttggtggaccctccattgcagaataccatcgcggtgcccaagaatggatgggccgcggtgagattccaagccttcaatccgggagtttggttcatgcattgtcatctcgaacgacacttgtcatggggcatggagatggcattcatcgttaaggatggcccgacctcagagtcgcagatgcttccacctccgccgggcatgccaccgtgctgatgtaatggaacatatgggttgttattagtccccgtttgaagtgttcttgttgagacgtcaatcttttatatttcatttttgttagtttgcagtatttgaaagtttaagggggcatctgaatcggaattcagttgctgtcctaatcaagacacgcaatgcttgatttgtccggtcataagaggagaagttgtaggattgttctttttttttttttttccgtttttgagcggaagaaatgtactcttctcattatctatacttgttgtaagaagttgctgatcaagaataaaacaacctgtgatcatattatatccacaggctgcgtatgcaaaaaaaaaa

SEQ ID NO: 175 - DNA, 2023 bp, Eucalyptus grandis
ggtcatccacaagaacccacctgagaagaaggaacgaagacgacggcaatggcggtctgcgcgacgaagctattggtctcagcttttgttgttgtcgggcttcttcttctcctctctgcaagcatcgtgcatggcgacgttcattaccatgatttcgtcctgaaggagaaaaactacacgaggctgtgcagtacaaagagtatgttagtcgttaatgacagttttccggggccaaccatttatgtgaagaaaggggacactttgtacgtgaacgtccacaaccaaggtgcctacggcgtcactatccactggcatggagtgaaccaaccgagaaatccatggttcgatggggccgagtacgtgacacagtgtagcatttcgccagggacaaatttcacgtatcaagttttgtttacggaagaggaggggtcgttgtggtggcacgctcacagcgagtgggcaagatatagtattcatggcttcatcgtcattcaccccgccgacggaacgtcctatccgtttccgcagcccgacggcgagaaagagatggtgctcgcgtcttggtacacggaggacgtttacgcgtccatcgccgagaagctcgccgcagggtcagacttgcttgtgtcggaggcgtacaccatcaacggcgaacctggagatttctgcgaatgctccaatgaaactacacacaggtggatggtcgattatggcaagacttatcttctccgcctactcaatgctgacatgaatgccgagctcttcttcgcaatcgcagaccacaacgtcaccgtcgtcggatccgatgcggcatacctcaagcccttttcttcggaaatcgtcttcattagtcctggacaaactatagacgtcctggtcacggcaaatcagcctccaggtcggtactacattgccgctaggcaatactacagcaaccagttcaaattcagtgagtacgatcacgccaacgcaacagcgattcttgagtatagtggaaactacactgccccatcgactcccgtcttcccgtctggtcttccgtcgtacaccaactataaagctgcaacaggctttgtgcagagtatgaggaacattatcgatcacgtcaatgttccgatgaatataacgactcgcatgtacatcactgtgtcgctcaacaagttcacgctcgaaatcaatgatacaacagaagaatcttacccatctgcaagcttaaataacatcagctggtataatccttggaccgatgtactgcaagcatattacagaaatatcagcggcttctacacgaccgattttccagaatttccgccgactttcttcaacttcacccagcataatttgcctctcaacaccacaaatgaaccagagagagggacgaaggtgaaggtgctcgagtacaatgaggaggtggagatagtgttccagaacactgacgtggcgaactcgtccgagaatcatcctatgcatctgcatggccacagcttctacgtgctcggcacaggtttcggcaattataacaacgagaccgaccctctaacgttcaatttgatcgatcctccttatcagaacactgcttcagtacccaaggacggatggcttgccattagattcagggcaagcaatccaggagtgtggctatggcactgtcacctggataaacacctcacttggggcatgaactccgtgttcattgtgaaaaatggcggcaccgaggacacgagcatccgagaccccccgagttatatgccttcgtgctatcctgacagcaaacttcggctcgaggagttctccaactcggatgagaagctatactcgacttcgatgtgatccgactcaatacatcttcgaggcattagcacaggaactctctcctccttgaaatagttcaccgaacgcatcaggagtcagtcattaaaaacggtttgattgtgccattatgtaagttgaacacgttcatagttatggaagcccttggcctgccttataataaacttgagatgatttttggttaaaaaaaaaa

SEQ ID NO: 176 - DNA, 1912 bp, Eucalyptus grandis
agatcacaagcttaaagaaacagagcacaagccaagtctcctctttacttctggatcgagtgattagtacaagttccattttgtatcagggagagagagggaccatgggaacatttctagggttcgcggtcactgcgaccctgctcttctgcatggctcaaggcaaagtcctcttctatgattttgtggtaaatgagacacctattgagatgctatgtgagacaaatcggagtgtaataactgtgaacggtctatttcctgggccagagattcgtgctcacaagggcgacactatttatgttaatgtcaccaacttaggaccttatggaatcactattcactggcatggagtgagacaaatacggtatccttggtctgatggcccggaatatgtcacgcaatgccccatccctacaaactcaagcttccttcagaaaatcaaactcactgaggaagagggcaccttgtggtggcacgcccacagcgactggtcacgtgccacaatacatggtcctataatcattttgccagccaacgacaccaactacccttatgagtttgacgaccaacacacaatcgtgatttctgaatggtatgcaagagatacgaaggacataatcgatgaggctcttgcatctggaggtgatccagacttgtccgtggcttataccatcaatggtcaaccgggagatagttattcatgctctaatggttcagcttacaatataacagttgtgcaaggaaaaacgtatctcctccggatcatccactccgggttgaatgaagagatgttctttggcatagccgagcacaatctcactgtggttggaatggatggagcttatctaaagccgcttaatactgagtacctcatgataactcccggtcaaacgatggatgttttggtcactgcaaaccaagccctcggtcgttactatatggttttcagtccgttcgtggacacaactgccccgtccaacgaaaatgttacgagaggaatattccaatacaacggcacttataaccactcagagactcccgtgttacctgaacttccaggttttaccaataagagtgacgctggaaactttactattcagttgaggagtttgaatagcgaagaacatccatccacggttccagccaacatcacaagaaacattacaatcacagtgtccgtgaatcagcaaccttgtcctgctaatcaaacgtgtaccggtccagacggctctatgcattcagcaagcttgaacaacataagtttttcagctccctcgattagcattctccaagcatactacaacaatcttctaggagtctacaatgaaacttttccagatgaaccacctttcatgtttgactacactgggaatgtatcggccttaggggaagctgccaacgtgagtaccgaagtgttgatgattaactataatgaggaggttgaaataagattccaagggaccaatttgggagcagcagagaatcacccaatgcatttacatggctatagcttttatgttgttgggatgggtgatggaaatttcagcgactcctatgtatcggattataatctagtggatccgccctatgttaacaccgtcggactccccaaaaatgggtggacatcgatcagattcaaagccgataatccaggagtgtggttcatgcactgtcatttagaacgccatgcgagctggggaatggacacagtcctcatcgtcggagacgggaagctaaagcatcagaaggtgtatccgccgcccagttacatgcctccttgtaccgtgtcttaatctggatgttgtttgctttgagttcattggtagtgcaaagggctatagacatcccaatgggaataaatcatctatattttgtactgaattatgcacttttgcatcattctaaaaggttt

SEQ ID NO: 177 - DNA, 2059 bp, Eucalyptus grandis
aaagtgggaagagacggagaaaagaagaagcgtacgatcatcaggaacatgcccgcccaagaccagtaaatgggaagagacagagaaaagaagaagcgtacgatcatcaggaacatggccaactcaacgtcgcctacctcgtacatttacttcgtcgccatctcactgtttctggggaatttggtcctcggagctcaagctagaaccgtccactactacgatttcgtgctgagagaaatcaacgttacgaggaattgcacgatcacgacgatcctggtggtgaacgatagttttcctgggccaaccattcgcgttcaaaaaggtgatcttgtgtacgtgaaggttcataatcaaggattatatggggtcactcttcattggcatggggtgaagcaaccacgaaatccatggtcagatggtccagagtatattacacaatgtgctattccaccgggaacaaatttcacttatgaagtgaatttaactgaagaagaaggaactatttggtggcatgcccataatgagtggacaagatctacagtgcatggtgctattgttgttttgccacgtgaaggatcaagtttcccattccctacggcagatggagagcatgtaattgtgcttggttcttggtataatgaaggaacttctctaaataaagccttagagatggaaatgtccatcggcagtcccaacatacctcgtgcaactggttacctgatcaatggacaatatggagattttgttccatgctccaatgaaacgacgcctcacttttttgttgattacggtaagacttatctcctccgtatagttagcgcagtagtcggtacagaaatgttcttctctatcgccgatcacaacatgactgtagttggaatggatggagcatacacaaaaccgatcgttgtttcatatctaatgatagaacctggacaaacgatggacatattagttaccacaaatcaatctccaggaaggtattacatggcagctcaacggtttgcaaccgaatacctggctttcactaaattttcccacgttgttgctactgcgattatccagtacaaagggaattacagtctgacatcaccaccaagttttccaattgataccctcccattttatcacgactatagtgccgcagtgagtttcacacatcaactgagaagtttagcaactgaagaatatcccgtggacgtcccttacaacgtgacgacaaggatgtttatcacagcttccctgaatagcttgccatgcccagacgattcgtgttatatgggtgattccaaactcgccgcaagtctaaataacataagttggaaggacccatctgtcgatgtgctgcaagcttattacagaaacatcagcggagtatacaccgcagattttcccgattttcctccagaaatgtttaatttcacgggagatgatttgccgagcagtcttgcggaggcttctgtagggacagccgtaaaagttctgaattacaacgaaacggtagagatagttttccaagggactaatttgttggagggatcagaatatcatccgatgcatatgcatggatacagcttttacatcgttgggctcggctcaggaaatttcaacaacgagaccgatcctctagcatacaatttggtcgatccgcccaaagtcaatacatttggagttcctagaagtggatgggttgcaatcagattcagggcagataatccaggtgtatggttttggcattgtcatatagaccgacatatgagctggggaatggattatgttttcatagtgaaaaatggggatacggaagagacaagtatgaggccacctcctccctatatgcctccttgcgttgcctcgaagaaggacaaactctttggtgaacaagatcggaatttaaaaagtgacatataattacaagattaggcgtatttataggcatcgggtagcaggtgcatgttcgcattattaatacgtaatttatatgtatttggaggcatttcttaattatgttcttatttatatcctaaatataattagggtttgtttgttaaaaaaaaaa

SEQ ID NO: 178 - DNA, 1728 bp, Eucalyptus grandis
gccatctctgataatttttttctagggagatcaagccatgggtgttcagcttattgtggccctcatatgcgctcttgtgataccgctgttagcagtcttttttattgacacgaaaaagaagacacgagcatttaggaatctccctcccggtcctaggaagttgccgatcattgggaatttgcaccagcttggctccttgcctcaccgatcgctcgcacgcctctcaaaacagtatggccagatcatgttactccaccttggctctattcccacgttagtcatctcatccgaagatgtcgccagagaagtattcaaagaccacgacactgctttctccggcagacccatcttttatgcgggaaagaagttagcatacaatcaatctgatataactttcagcacgtatggcgaatcctggaaagaactcaagaaattagtgacccaagaactcctgaacaataagagagtcaagtcatttgaatctgtgaggaaggatgaggtcaagcttatgctcgatgcaatcacttcttctccaggtcctgttaatattggtgaactgtcacttctattgagtaacaacatcgtgtgccgtgtggctttcggtagcaaatatcaggctgatggtagcagtgtaaagagcaaatttcatgagacaatccgtggaatacagaaaattttagggggcttttgtgttgcagatctgttcccatatatggcttggtttaacaggctcaatggcttcaacgcaaaggttgaaaagaatttcatggagttagacaagttttatgatgaagtgatcgagcagcaccaagaccctcagaggcctaaactcgatcatgaagatcttgttgatgtgttgcttcggttacaaagggatccaaatcaaatgaatgccctcactagggaacaatttaaaggagtattaactaacattttcaatgcaggaacaggtacctctgcaaccactatactctgggcaatggcagaactcgtccgcaatccagctgtgatgagaaaagcacaagaagaggttcgagaagtagcaaaaggaaagttacatgtcgaagagactgaccttctaggactcacctacctaagatcagtcatcaaagagacattaagactccatccgccgcttcctcttctagttccaagagcaacgatcgaggattgcaagataaggggatacacagttcctagaggaactactgtattcgtcaatgtgcaagcaatcgccacagacccaaaatcttgggaaaatccagaagagtttaggcccgggaggttcttgaacagctccatcgatttcaccggacagaactatgagtatctaccatttggttctggcaggcggggatgccctggcagaaactttggtgtcgtgatagttgagcttgcattggcaaatctccttcatcggttcgattggaaactgcctaaagggatgagtgttgaagatattgacatggaagaagcttatggcctttcgactcacaagaggactcctctttgcctgatagcaacccccatgactggttgacgttacattccgatactaccaatagaaaagtttgcttgatttgttccgtaataatgcagactttattctgtcttgtgtgcctactacaagttttccagtttcactttgtggcaatagctgttcctagatcttgtaacctgaataattcataaatttggaacagcaaagatcttagtacaaaaaaaaaa

SEQ ID NO: 179 - DNA, 1602 bp, Eucalyptus grandis
gcagaggcaagcctcataagcctgccatggattacttggtcttgattttgtgccttcacttactgtggggtttgatccaagttctctctttcgttgcagcgagaatcaaaaaggctccctccaacctcccacccggtccgcggcctcttccactcatcggtaacctcctcgaactcggaaagcttccccatcagtctcttgctaggctagctcgcacttatggccccataatgaaacttcagctcggctttgtaaccacggttgtcatttcctctccaacactcgccaaagaaatcctccaaacccacgacgctctattcttgaatcgaaccattcctgataccatcacggcccacaatcatgatcaattcggcttgccttggatacccatttcacctctctttcgaaaccttagaaaaatgtacaactcacatctattgtcgaataagaaacttgattccaaccagtaccttcgcaagaagaaagtggaagagcttgtttgttacgttcagaaatgtgcgcagaatggtgatgttatagacattggcgaggcagcttttacgactagccttaactctctgtcgaacacggttttttcattggacatgacgtacccttcaaattcagctaaagagttgaaggaggtggtggggcaaatcatggctgaggctgggaagccaaaccttgcagattactttcctgtgctaaagaagattgatccacagggtttgaagcagcggatggaattgtattttggcaaaatgtttgatgtctttgatgttctcatcaagaaaaggtggcaacagaggatgcaatctggttcagttgctagcaacgatgtcttggatgctcttcttgatgtaatggaagagaagagtgaggacatggacatctctctagtcaagcatctgtttctggatttttttgttgccggtaccgaaaccacttcaagtactctagagtgggcaatggctgagctgctttgcaactcagagaagctatcgaaagcccaaaccgagctccacgaagtcattggcaaaggcaaccagatggaggaagttgatgtacctcgcttaccgtatttacaagctatcgtaaaagaaactttccgacttcacccaccatttccacttcttctcccacgcaagtctgaggccgacacacaaataggcggtttcacaattccaaagggtgcacaagttcttatcaatgcatgggctataggaagagatcctagcatttgggtcaatccaaatgagtttgtaccggagagatttctaggatctgatatagatctccggggaaaaaatttcgagcttgttccgtttggtggtggcaggcgaatttgtccaggattgcctttggccgcgagaatgttacatctgatgctgggttcgctaattaactcatttaattggaagctcgaagatggtgtcacaccagaaaatatgaacatggaagacaagttcgggatcagcatgcagagagctcaacctctaaaagccgttgccttaccagcgtaaattggggaaagatttatgtcataaaacgtgtactaataaagattcctcatattaaaacattcggtgcccaaaaaaaaaa

SEQ ID NO: 180 - DNA, 1698 bp, Eucalyptus grandis
accccacttccttccaaataaccaccaccaaaatggcttggatctggataacactctccttcactttgattgctcatctcttattgcgagctttgccatggaaaagaaagagcaagaagaaattgcctcctggtccaatagggtatccaattcttggaaacctccctttgttaggacaaaacccgcaccatgatcttcacaaattagctcaaaaatatggccccctcatgtacttgcgcctcgggtttgtgcacacgatcgtcgtctcatcgcccgagctggccgaacaattcctcaagacccatgatcttgttttcgcgagccggccacctcatgaggcctccaagcacatctcttacgagcaaaggagcttggcgttcgcgccgtacggcccatattggaggaacatcagaaagatgtgcactttggagctacttagcaatgcaaaaatcaattcctttaagtccatgagaagagaggaggtcggcttgcttgtgaattttctcaaagacgcggctcacgaccacacagccattgacttgagctcgaagatcttttcgctaagcgccgatatgagttgtcgaatggtcttcggaaagaagtacatggacaaggagtttgatgagagagggttcaaggccgtgattcaagaaggcatggtgttgggcgcgacaccgaacatcggtgactatgttccttatttagcacgatttgatcttcaggggttaacgaaacgcatgaaagccgtgagcaaagtgttcgatgccttctttgagaagattattgacgagcacatgaagtctatgaaagaagaaggagagagcaaagattttgtggatgttatgctgggcttcatgggattgaacgagggagagtaccatatcgacaggccccatatcaaagccataattctggacatgttgtcgggttcgatggacacttcagcgacagcaatagactgggcaatgaccgaacttgtaagacatcctagtgcaatgaaaagggtccaagatgaactagagaaagccgtgggaatgaacagagcagtagaggaatcagatttagagggcttgcactacttagacatggtcatcaaggagaccatgaggcttcacccggtggctccgcttttgcttccccacgaggcgactgaggactgcacagtgaacggcttccatatacccttgaagtcgagagtcatcgtgaatgtgtggtccattggaagggacccaaaagtgtggaccactcacgatccggaagagttcatacctgaaagattcttagggtcgagcatggacgttaaggggcgtgattttcagctcctaccgtttggggcaggccgccgaggatgccccgggatgcagcttggcttgactgtggtgcgatttgtgcttgctcaactcgtacactgctttgattgggaccttcccgctggcatatcaccgagcgagcttgacatgactgaggagtttgggctcactgctcctagagctaagcatttggtggtcatgcctcggtaccgtttgagtgagtgaaagagagttaacttttcaatagatgattgagttcccaaaaataagtctgatattatcatgaagtctcctagtgttagtcaccaaatggattgcctaccaatttgtaatgaagttttagcttgatttttgaagtattattatctgaatgaaattcaaataaagg

SEQ ID NO: 181 - DNA, 1654 bp, Eucalyptus grandis
catgaccatcctccggcaatggctcttcacatcctcttcacatggcttgctctttcccttcctctcctcctcctcctcctcctctcagtgaaaaacttcaataacaaaaagaagaatctccctccagggcctccatcacttcccatcataggcaacttccaccagctcggccccatgcctcatcagtctctgtggaaactctccagacgatatggccccgtcatgctcatccgcctcggtggcacccctaccatcgtaatctcctcccctgatgctgccagggaggtcctcaagacccacgaccttgatagttgcagtcgcccgcagatggtcggcacgggacgcctctcctatgattccctcgacgtggccttcgtggagtacggcgattactggagggagttaaggacgctgtgtgtgctcgagctgtttagcatgaagcgagtccagtccttccgatacatcagggaagaggaggtgggatctatgatcgaatcgatcgcaaaatcagcagagagcggaactccggttaatatgagcgagaagttcatggctctgacggctaacttcacttgcagggtcgcatttgggaagccatttcaggggacggagttggaagacgaagggttcatggatatggttcacgagggaatggcgatgttgggaagcttctcggcatctgattatttccctcgactcggctggattgtggacaggttcacggggctccattcgaggttggagaagagctttcgcaatttggacgatctctatcagaaggtgatcgaagagcatcggaatgcgaataagagcaacgagggaaaggaggacattgtcgatgtgctgctgaagatggagaaagatcagactgagctcgcgggggtccggctcaaggaagataacatcaaggccatcttgatgaatatatttctcggaggagtggacaccggtgcagttgtcatggactggacaatggctgagctcgctaggaacccgagggtgatgcgaaaagctcgagaggaaatccgaagttgcgttggaaacaagaaatgggtcgtagaagaggacctcagcgggctcaaatatttgaagttagttcttaaagaagtaatgaggctacaccctccaggtgttctactcataccaagggaaaccattggccacttcaagctatctggctacgatgtcgacccgaagagctgtgtctacgtgaatgcgtggggcatgggacgggacccaggactgtgggagcgtccggaggagtttgtgccggagaggttcgaggacagtccaatcgattacaaggggaatcatttcgagctgataccatttggggccgggcggaggcgatgccctgggatgtcgatggtcatggcgatgatcgagctggcgcttgccaatgtcttgcactccttcgattgggaattgccggagggaatgacagagggagatgtgaacatggaagaaggggctggcctagccgtgttcaagaaagtgcctctcactctgttgccgataaaggcatcgcataaaattgacgcatgacgaaagtgtcgacaaatgtaaaacatcatgtttcacaacgtcttgtacttgattatgatcaagcgtcttaaaattgtatggtacaatattctagtatgcaacatctcca

SEQ ID NO: 182 - DNA, 1654 bp, Eucalyptus grandis; identical to SEQ ID NO: 181

SEQ ID NO: 183 - DNA, 1654 bp, Eucalyptus grandis; identical to SEQ ID NO: 181

SEQ ID NO: 184 - DNA, 1654 bp, Eucalyptus grandis; identical to SEQ ID NO: 181

SEQ ID NO: 185 - DNA, 2024 bp, Eucalyptus grandis
ataaaatccccaccataacaccaccttgaagaccagcaacgcttatcgctcagttgcacagcccaacgacgaaccccttactcaaagaagggacgcagatgagagacgccatggactctcttctgcaagccctgcagaaccagccgctccccgccgccgccgccgccgccaccctcgtcctcgtcctcctcggcctcgccctcctctcccgccgccgccgcctcccctaccctcccggccccaggggcctcccgatcatcggcaacatgctgatgctcgaccagatgacccaccgcggcctcgcgagcctcgcccgcaagtacggcggcctcctccacctccgcatggggttcctccacatggtcgccgtgtcgtcccccgagcacgcccgccagatcctccagctccaggaccacaccttctcgaaccgccccgccaccatcgccatcagctacctcacgtacgaccgggccgacatggccttcgcccactacggcccgttctggcgccagatgcggaagatctgcgtcatgcgggtgttcagccgcaagcgggccgagtcctggaggtcggtcagggacgaggtggacaagaccgtgcgggccgtcgccggcagcatcggcaccgtcgtgaacatcggcgagctggtgttcgcgctcacccgggacatcacgtacagggctgcgttcggagcgagcgcgaccgaaggacaagacgagttcatcgggatattgcaggagttctcgaagctgttcggggcattcaacctcgccgatttcatcccgtaccttggccggatcgacccgcaggggatcaatgagaggctcgtcaaggctcgcgggtcgctcgacaggttcatcgacaagatcatggacgaccacatggagaagaagaacaaggacaagaccctcctcagtgaggaggcggagacggacatggtggacgacttgctcgccttctacggcgaagaagaggcgaaagtcaacgagtcggaggatctccagaactccatcaagctcaccagggagaacatcaaggccataatcatggatgttatgttcggtgggacagagaccgtcgcgtcggcgattgaatgggcgatggcggagctgatgcggagccctgaggacctcaagaaggtccagaaggagctcgccgacgtggtggggcttcaccgccgggtcgaggagtctgactttgagaaattgacctacctaaagtgcgtgatcaaggagacactccgcctccacccgccgatccccctcctcctccacgagacggcagaggacgcggaggtctccggctacttcatccccgccaagacccgcgtcatgatcaacgcgtgggccatcgggcgggacccgacctcgtgggaggacccggacaccttcaagccctccaggttcctgaacgagggtgccccggacttcaaggggagcaacttcgagttcatcccgtttgggtcgggccggaggtcttgcccgggcatgcagctcgggctctatgggctagagttctcggtggccaacctcatccactccttcacgtgggagctgcctgacgggcagaagcccggcgagatggacatgagcgacgtgttcgggctcaccgcgccgagggctgaacggctcatggcgatcccgagcccgaggctgttgtgtcccttgtattgagacgaggcatcgaaccgaaccaaatcgagagggcatccgagaaatgtgtgtgaaatggctggctttgcatgcgcttcactcctttgcatggcgttccttttgttcctatgcaatccttttttcttcttatttttcaccaccccttttttttcccttgagagtgagcgaaagtcagtctcaccttgcttcgtttttcttttcacatgttcattcaataattgtcgcttcacatacaaactaaaaggccaaagattttcaatttggttagaggaaatattatgggttgcttgtacaaatgaaaataacaaaaaaaataaaagcaataacattatgttattgttaaaaaaaaaa

SEQ ID NO: 186 - DNA, 1933 bp, Eucalyptus grandis
gctcttgttcaaactcaactccagcaatctcccatgaccctcctcctctccgtcgtccctcttctcctcttcctcgggctcgtggctcggctccggcgcaagccgcccttcccaccgggcccgaggggcctcccggtcatcgggaacatgctcatgatgggcgagctcacccaccgcggcctcgcgagtctggcgaagaagtatggcgggatcttccacctccgcatgggcttcctgcacatggttgccgtgtcgtcccccgacgtggcccgccaggtcctccaggtccacgacgggatcttctcgaaccggcctgccaccatcgcgatcagctacctcacgtatgaccgggccgacatggccttcgcgcactacggcccgttctggcggcagatgcggaagctgtgcgtgatgaagctcttcagccggaagcgggctgagtcgtgggagtcggtccgcgatgaggtggacacgatggtgcgcaccgtcgcgggcagcgaggggaccgccgtgaacatcggcgagctcgtgttcgagctcacgcgggacatcatctaccgcgcggccttcggcacgagctcgaccgagggccaggacgagttcatcagcatactgcaggagttctcgaaattatttggcgccttcaacatagccgattttatcccgtacctgagctggatcgatccgcaagggctcaccgccaggcttgtcaaggcgcgccagtcgctggacgggttcatcgaccacattatagatgatcacatggacaagaagagaaacaagacgagttccggtggaggcgatcaagatgtcgataccgacatggtcgacgatctgctggccttctacagcgacgaagcgaaggtgaacgagtccgacgatttgcagaactcgatcaggctaacgagagacaacatcaaggccatcatcatggacgtgatgttcggcgggacggagactgtggcgtcggctatcgagtgggccatggcggagctcatgcgaagccccgaggacctgaagaaggtccagcaagaactcgcggatgtcgtgggcctagaccggagagtcgaggagagcgacttcgagaagctgacctatctcaagtgctgcctcaaagagaccctccgcctccacccgccgatcccgctgctcctccacgagacggcagaggacgccgtgatctccggctaccgcatccccgcacggtcccgggtcatgatcaatgcatgggccatcgggcgtgaccccggctcgtggaccgaacctgacaagttcaaaccgtcccggttcctggagtcaggcatgcccgactacaaggggagcaacttcgagttcatccctttcgggtcgggccggaggtcgtgcccagggatgcagctcgggctctacgcgctcgacatggccgtggcccacctcctgcactgcttcacgtgggaactgcccgacgggatgaagccgagcgagatggacatgggcgacgtcttcgggctcaccgcgccgaggtccacccggctcgtggcggtgccgactccgaggttggtgggggctctatattgagcaagcaaatggagggtcgggttggggggtgcgaggaggggaacgtatttttcagctcctggagggctgcaagatttggagtgcataaacccatccatacaagggcaaaagagggtggtgccaaaatgatttgcatggatttttcgatttttgttttgtattataaaaaaggtcaaataaccgaagaggacaagaaagacaagaaaaagaattgagacggaacttgaatcaatgttgttctgttctctctttctatttctttgtggatattacaagacttatctcatttggtgggcttttcttttcttgtgatttctttgatcttgtcatacacaaataaatatggaatgaagaaacctttccatcaaaaaaaaaa

SEQ ID NO: 187 - DNA, 2019 bp, Eucalyptus grandis
caacatcctaaatcattacaagctctcgctctctagggccatggcgctcctctccctaatcctggccaccgtagccatctcggccttcctctactccctcctcggctatctctcccggcccgcccggccgctcccccccggccccaggccgtggcccctcgtcgggaacctgccccacctcggccccgtcccccaccactccatcgcggccctcgcccggacctacgggccgctcatgcatctgcggctcgggttcgtcgacgtggtggtggccgcgtcggcctccgtggccgccgagttcctgaagacccacgacaccaacttctcgagccggccgcccaactccggggcgaagcacatcgcgtacaactaccaggacccggtgttcgcgccctacggcccgcggtggcggatgctgaggaagataagctccgtccacctcttctccggcaaggctcttgaggattacagacacgttcgccaggaagaggtcgccatcctcacgagcgccctggcacgtgcgggttcggccccggcgaacctggcccagctgctcaacgtgtgcacggtgaacgccctggggcgggtgatgctggggaggcggatgttcggggacgggagcggcgggggcgacgcgaaggcggacgagttcaagtcgatggtggtggaggtgatggtgctggcgggggtgttcaacatcggcgacttcgtgccggccctcgagtggctcgacctccagggggtggcggccaagatgaagaggctgcacaagcgctttgacgccttcctgggggccatcgtggaggagcacaaggccagcatgggccgtggcgggaacaagcacaatgacctgttgagtacattgatctctttgcaggatgttgccgatgaggaaggagggaagctcaccgacaccgaaatcaaagcattgctgctaaacatgttcacggcgggcacggacacttcctctagcaccacggaatgggccatcgccgagctcatccggcaccccgacatcctgacccgagtccaggaagagatcgactcggtggtcggacaagaccgcctcgtgaccgagctcgatctgccccgcctgccgtacctccaggcggtgatcaaggagaccttccggctccacccgtccacccctctgtccctcccgcgggtcgcggccgagagctgcgagatcaacggctaccacatccccaaaggcgccacgctgctggtcaacgtgtgggcaatagctcgcgaccccgacacttgggccgagccgttggcgttccggccggagaggttcctgcccggcggcgagaagcccaatgtcgacgtcaagggtaacgatttcgaggtcattccgttcggggccgggcgcaggatatgcgccggagtgagcctgggcttgaggatggtccaattcatgacggcgacgttggcccacgctttcgactgggagttggccaacggggccttgccggagaagcttaacatggatgaagcttacggtctcaccttacagcgagctgagccgctgtcggtccacccgaaaccgaggctcgccgcgcatgcctacaaggcctcgagttgaagcgttagcgaacgtcggtctggcggtttcgcacgtttggtttgatgaacagagaggtccatttgcttggaaagcagttcaggttgcgttcttgtttcacacgtttggtttgatgaacagagaggtccatttgcttggaaagcagttcaggttgcgttcttgtttcacacgtttggtttgatgaacagagaggtccgtttgcttgaaagcagttctggttgcattcttcatacgcgatttgcatctcagtcgcaagttgtatctctatgctagtggtcctgtgagatgatggtacagagtattattggcaaaggtggtccagagaacatgcaaggacccaagctccgactgtttcgcagacaacgaaacatttagaaataatttccctgagaataatcacatgtatcacttaaaataaaaaaaaaaaaaaaaaa

SEQ ID NO: 188 - DNA, 1768 bp, Eucalyptus grandis
cggatccgtaccagatggacacggacaacaaactcttcaatgtgggcgtcttgctcgtggccactctcgttgtggccaagctaatctcggcgttgctgattccgagatccggaaagcgcctccctcccgtcgttaggacatggccggtggttggtgggctgctccggttcttgaagggtccgatggtgatgctgcgggaagagtaccccaagcttgggagcgtattcactctgaatctgttgaacaagaaaataacgttcttcatcggccctgaggtttctgcgcacttcttcaaggcttccgagtccgatttgagccagcaagaagtgtaccaattcaatgtgccgactttcggacctggagttgtattcgacgtcgattacaccatcaggcaagagcagtttcggttttttactgaggctctgaggattaataagctcaaggggtatgtcaatcagatggttatggaagcggaggactacttctcaaaatggggagatagtggcgaggtggacctaaagtatgagcttgagcacttgaccatattgacagcgagcagatgtcttttgggtcgagaggttcgtgagaagctctttgatgatgtgtcagccctcttccacgaccttgacaatggaatgctaccgatcagtgtcatcttcccctacctgcccatcccagctcaccatcgtcgcgataaggctcggaagaagctttctgagatttttgcaaacatcatttcttcacgaaaatgtgctggcaaatcagaagaagacatgttgcagtgcttcattgactccaagtacaaaaatggtcgcccgacaactgaggccgaggtcactggtctgcttattgcggctctctttgcagggcagcacaccagttctatcacttccgtgtggactggggcctacctcctcaccaacaagaagtacctctctgctgtctctaatgaacagaagcacctgatggagaagcatgggaacaatgttgatcatgatgttctttctgaaatggatgtcctgtatcggtccatcaaggaagcactgagacttcacccacctctaattatgctgctccgaagctcacatagtgatttcagtgtcaaaacacgggatggcaaggaatatgacatcccaaagggccacattgtggctacttcgcctgcttttgctaatagacttccatacatttatcaggatccagaccagtatgatccagacagatttgcagtggggagagaagaagacaaggtggctggagcattttcttatatttcttttggaggcggtaggcatgggtgccttggtgaaccatttgcctacttgcaaattaaagcaatatggactcacctgttgagaaacttcgagctggagttggtttcacctttcccggagatcgactggaatgctatggtggttggtgtcaagggaaaagttatggtgaggtacaagcgccgacagctctctgtttagacgagaggctttggtcgtcatcgtcttgtttcatgccccttgcgacagccttgctcctttcttagcttctggtgtttctgtttgtgttgaaagtagggatttttagctccagctcgtttgtgactattgtagcttctgacccagggctcatcatgtttcagttattagttgctcaagcttgggtttttgcatcatgtgttgattacttttcagtgcaatgaactttttcgtcaacttggcagcaatatttatctcctagagacatcaagaaatcaaaaaaaaaaaaaaaaaaaaaa

SEQ ID NO: 189 - DNA, 1768 bp, Eucalyptus grandis; identical to SEQ ID NO: 188

SEQ ID NO: 190 - DNA, 3105 bp, Eucalyptus grandis
catcatcaccgccacctccctcctcctcttccccctcctcctcctcctcctggtcgccccgcaaaggccctccgcctctgtccgcagtcaccgccagccatggatctcctcctcctggagaagaccctcctgggcctcttcgccgccgccatcgtggccatcgcggtctccaagctccggggcaagcggttccgcctccccccgggccccctccccgtgcccatcttcggcaactggctccaggtcggcgacgacctcaaccaccgcaacctcaccgacctcgccaagaggttcggcgacatcctcctcctccgcatggggcagcgcaacctcgtggtcgtctcgtccccggacctctccaaggaggtgctccacacgcagggcgtcgagttcgggtctcgcacccggaacgtcgtcttcgacatcttcaccgggaaggggcaggacatggtgttcacggtgtacggggagcactggcgcaagatgcgccgcatcatgacggtccccttcttcaccaacaaggtggtgcagcagtaccgggaggggtgggaggccgaggccgccgccgtcgtcgaggacgtcaagaagaaccccgccgccgcccgcgaggggatcgtgctccggcgcaggctgcagatgatgatgtacaacaacatgtaccggatcatgttcgaccggcggttcgacagcgaggacgacccgctcttcgtcaagctcaaggccctcaacggcgagcggagccgcctggcgcagagcttcgactacaactacggcgacttcatccccatcctgaggcccttcctgcgaggctacctgaagatctgcaaggaggtcaaggagcgcaggctgcagctcttcaaggactacttcgtcgacgagaggaaaaaactggccagcgtgaagcggatggacaacgaggggctgaagtgcgccatggaccacatccttgaggcgcagcagaagggcgaaatcaacgaggacaacgttctatacatcgtcgagaacatcaacgttgcgggtacctctcgaaaaattgcttgcccttcttttctttctgcaattaagcccgtactggcaaaaaatctttacaattggatccacaaagtaaatgggcaattgcccatttcgagtaaaacctatgaatcgaactcgtcggacaaaacaggggagagctaggataggaatggaagaaatggggtgtttagaagaacacgtcattgccggcctgaagtcaaatcgaccacttggatgtttgtggggtagaaaacgtaagtaacgccggctgccgggtggcatgtcgttgtactctcttgccgttaagattgcgacgcgtgttaggttgggggccacttctcgagcccatatatggttgtgtataggtgaagcgaaaccatgataaaagaggaagatcgggtcaaccgctttgactagttatcattgctgctagacaagaggggcagttcggtaaaataccgataaaataggctggggaaatagcaaagccattttcgggggggagatggacatgatcagatggcgaaatcgtgttattttatttggccaaaaattcagatgaaaagctcgataacgatgacggtccatttgccacccgatctagcggtgtggctggtgccccactttaatgctatttatttaatatgaggataagcaagaggataatgtgaagttggcccttttttgcccgtccggctcgtgacgtactcatggaccatctcccgccgcgattttcgatgataggaaaaaggccattagcgcattgaaaattccaacttttccttttcggcttcgagagcgccttttttccaaatttccattcgatttgcttagttaaagccgatattggagaaggtgtgcgagtcgaataagcaaaggaaacgtttgtggggtcccgaaggtgggaaggattggcgtggcttgcgttccaacgcgggggttgaaatgtcaaccgcccgatggaaacctacttcgtgcgcgggtgcgcgacggttgatgaacgaagttgcccgaccaacccccgcacgaaaaacccaccttctcccgcgtcatactcacctaccaagacgcaccacaccaaccgcaccagtccgtgccttttttcccgtcggttcatgtcctttttgtcggtcgtaggttcgtgcccgcgtgagggggagtagttctcgtgtggtaggtgagcactgacgggcgtcgatgtcacatagaagaaaatgagccgtcgatttgtttcttcgaccgtacatttgtggtcgaatggaatgctgatgagttgacatggtgcagcgatcgagacgacactatggtcgattgagtggggaatcgcggagctcgtgaaccacccccagatccagaggaagctgcgggaggagatcgacgcggtcctgggccctggcgtgccagtcaccgagcccgagctctacaagctgccgtacctccaggcggtgatcaaggagaccctgaggctccggatggcgatcccgctcctcgtgccccacatgaacctccacgacgccaagctcgggggctacgacatccccgccgagagcaagatcctggtcaacgcgtggtggctggccaacaaccctgcccactggaagaagcccgaggagttccggcccgagcggttcctggaggaggaggcgaaggtcgaggccaacgggaacgacttccggtacctccccttcggagtcggccggaggagctgccctgggatcatcctggccctgcccatcctcggggtcaccatcggccagttggtgcagaacttcgagctcttgccgccccctggacaatcgaagctcgacaccactgagaagggtggccaattcagcttgcacatattgaagcactccaccatcgtcttgaagccaagatccttttgaagttagtctccacagagattcaacttttggtggctgttgatttcacttggacagtattaaaatatgaagaattggacaaagcatattcaggagttgccatgagaacttatgttgtgtcttgtgttgggaaaataacagcttttatgtcctttgagaactgaaacttatcttttgaaaaaattgtttatctgcagcaaaaaaaaaa

SEQ ID NO: 191 - DNA, 1796 bp, Eucalyptus grandis
gagagagaagccaagagagagaagaccccctcctcctcctcctcctggtcgccccgcaaaagccctccgcctctgtccgcagtcaccgccagccatggatctcctcctcctggagaagaccctcctgggcctcttcgccgccgccatcgtggccatcgcggtctccaagctccggggcaagcggttccgcctccccccgggccccctccccgtgcccatcttcggcaactggctccaggtcggcgacgacctcaaccaccgcaacctcaccgacctcgccaagaggttcggcgacatcctcctcctccgcatggggcagcgcaacctcgtggtcgtctcgtccccggacctctccaaggaggtgctccacacgcagggcgtcgagttcgggtctcgcacccggaacgtcgtcttcgacatcttcaccgggaaggggcaggacatggtgttcacggtgtacggggagcactggcgcaagatgcgccgcatcatgacggtccccttcttcaccaacaaggtggtgcagcagtaccgggaggggtgggaggccgaggccgccgccgtcgtcgaggacgtcaagaagaaccccgccgccgcccgcgaggggatcgtgctccggcgcaggctgcagatgatgatgtacaacaacatgtaccggatcatgttcgaccggcggttcgacagcgaggacgacccgctcttcgtcaagctcaaggccctcaacggcgagcggagccgcctggcgcagagcttcgactacaactacggcgacttcatccccatcctgaggcccttcctgcgaggctacctgaagatctgcaaggaggtcaaggagcgcaggctgcagctcttcaaggactacttcgtcgacgagaggaaaaaactggccagcgtgaagcggatggacaacgaggggctgaagtgcgccatggaccacatccttgaggcgcagcagaagggcgaaatcaacgaggacaacgttctatacatcgtcgagaacatcaacgttgcggcgatcgagacgacactatggtcgattgagtggggaatcgcggagctcgtgaaccacccccagatccagaggaagctgcgggaggagatcgacgcggtcctgggccctggcgtgccagtcaccgagcccgagctctacaagctgccgtacctccaggcggtgatcaaggagaccctgaggctccggatggcgatcccgctcctcgtgccccacatgaacctccacgacgccaagctcgggggctacgacatccccgccgagagcaagatcctggtcaacgcgtggtggctggccaacaaccctgcccactggaagaagcccgaggagttccggcccgagcggttcctggaggaggaggcgaaggtcgaggccaacgggaacgacttccggtacctccccttcggagtcggccggaggagctgccctgggatcatcctggccctgcccatcctcggggtcaccatcggccagttggtgcagaacttcgagctcttgccgccccctggacaatcgaagctcgacaccactgagaagggtggccaattcagcttgcacatattgaagcactccaccatcgtcttgaagccaagatccttttgaagttagtctccacagagattcaacttttggtggctgttgatttcacttggacagtattaaaatatgaagaattggacaaagcatattcaggagttgccatgagaacttatgttgtgtcttgtgttgggaaaataacagcttttatgtcctttgagaactgaaacttatcttttgaaaaaaaaaa

SEQ ID NO: 192 - DNA, 1910 bp, Eucalyptus grandis
tctctcttatcatctctctccgcgaacatggctcgtcttacctccttcgtttatgcaactctccttgcatccacgctcattattctcgccaactttttgacatcccgcttgtccattcaactacctttctggtcggcctctcttgtcgtctctcttcctctcatcacttgcttgttctacctatttttcgaccgtggcgccaacttgcccccgggccctctggccatcccgattttcgggaactggctccaggtgggcaatgacctcaatcaccgccttctagcctccatgtccaagacttacggccccgttttcctgcttaaactcggcgtgaagaagctagtcgtggtgtccgaccctgagctgaccacacacgtcctccatacccaaggcgtcgaattcggatcccgccctagaaacgttgtgttcgacatattcacgggcaatgggcaagacatggtgttcaccatctatggcgatcattggcgcaaaatgcgtcgcatcatgacgctcccattctttaccaacaaggtggtgaacacttacagtgatatgtgggaacaggaaatggatttggttgtcagcgacctaaccaaagatgagcgagtgcgaagcgaagggatcgttatcaggaagcgtctgcagttgatgctctacaacatcatgtatcgaatgatgttcgactccaagtttgagtccatgcaggatccgttgttcattgaagccaccaagttcaactccgaaaggagtcgcttggctcaaagtttcgactacaattacggggatttcattcccatgctcagacctctcttgaaaggttacttgaacaagtgcagggacttgcagcgcaggcgccttgccttttttaacaactactatgttgagagaagaaggaaaataatggcagcgaatggggacaagcaccagataagttgtgccatcgactacatcatagacgcgcaaatgaagggcgaaatcagcgaagccaacgtgctctacatcgtggagaacattaatgtggcagcgatagaaacaaccctttggtccatggaatgggccatagcagagctggtcaatcatccgaatgtccaacgcaaaatcagggaggagatctccgctgtcctgaaaggggagccggtcacggaatcgaacctgcacgagttaccctatctgcaagcaacagtgaaggaaacactgaggctgcacacgcccatacctctgttggtgccccacatgaacctggaagaagccaagctaggcggctacaccatccccaaagagtcgaaggtggtggtgaatgcgtggtggttggccaacaaccctgaatggtggaaggacgcggaagactttaggccagagaggttcttggaagaggaaagcgggacagatgcagtggcgggcgggaaggtggacttcaggtacttgccatttggggtggggaggaggagctgcccgggcattattctcgcccttccgatattagggcttgtcgtcgccaagttggtgtccaacttcgagatgaaagtcccgccgggaatggacaagctcgacacgagcgagaaaggaggacaattcagcttgcatatcgccaaccattctaccgtcgtctttgagcccgttgctccccgggagatttgattccatcgcattaaaccaaatgggcagccactattttggaacttgaacgaaccctttctttcttctttgttttccgagtctctttgcagacgctataaagcaagtgaatttgtaatatgttttatttaaccatgtcataataacagtgcatctcgtgtcctcctcaatgtaggattcctcttccatttcccttgttatatagccagacagagatcattgtgcgccattttagaagtttatggggaatccaagatatgatttgaaaaaaaaaa

SEQ ID NO: 193 - DNA, 1455 bp, Eucalyptus grandis
gcacgagggaggattcctgtcctctgccattaacctcccaaaactcagtgaaaaacactatataaagggcagctcctcatgtttaccaacccatccacaaaccaactcttcaatccctcatttctcaaactccacctttgatctctcagcaacagtgcagaagccaacatggatcctagcgagacccaatcgatcacgacgcctgctgaggatgaggagctcgtggctgccttcgagacttgcatcctcacggccgtccccatggtgttcacgtccgccgtcgagcttgggatcatcgacttgctagcccaggaaggcggggcctccgcccggctctcaccgtcccagattgcggtccgcctcgggatcaccaacccggacgccccacgcaccatcaaccgcatgctacggctcctggcgagcttctcctacttgtcgtgcactcttcatggcgatcagagtctgtatggcctcgggccaaagagcaagtactttgtgaacagcgaagccggttctttcacgccattgctgcgattcctccaacataagaccgtcatcaacggctggtatgggttgcaggaagcagttaaaaatggaggaagcccctttcagaatgcaaacgggatgagcatcttcgagtgcgccatgaaggaccccgcgttcagcacgctcttgaacaacgggatgaaagccccgaccccgctttacatgaacaagttgctcgagtcttaccacgggtttgaaggcgcgaagacggtcgccgacgtgggcggtggggtgggcgagaccctccggctcatattggacaagttcccaaatctcaggggcataaattatgatctgcctcatgtggtcaaagatgcacctacccatcctcgcatggaacatgtcggaggagacttgtcaaagtctattccaaaagcagatatcctcttcatgaagtggcttttccatggtcgacccgacgatttctgcaaaaagctactcaagaactgttacgatgcactgccaccaaatggcaaggtggtcatcctggaccctatccttcctgattaccccgagaccgacatagtgtcaaggaacacattcacctccgacatgatcatgctaggtgcaagcccaggaggggtcgaccggacgaggaaagagctggaagcactcgctctttcagccggatttgataagccaaggatcctgtgtcgagcttacaacatgtgggttatggagttgcacaaaaagaagtgatcactctcgagtcgctcgtggcatgattccctcattttaggatttctcatgcccggaaaaatgaaagataaaaaaggagtcacccgtaaaataaaagccatcttatcgggtagaataatgcagcataatccttgagattcaataagaaagcgtgattgttccgtctccatgaggcggttcctcacttccttctcaaaaaaaaaaaaaaaa

SEQ ID NO: 194 - DNA, 1455 bp, Eucalyptus grandis; identical to SEQ ID NO: 193

SEQ ID NO: 195 - DNA, 1283 bp, Eucalyptus grandis
ataccagcatcttcgattagcagaaagccaaaagaaaagacagtcggaagaaaaaatataaaaaaaaacatgagttcgaaggaagccccagtcattacaacttcccatgaagatgaagaaattttgaatgcctttgaggtcccctcaatggcttttgttcccatggtcttgaaaggcgtccatgagctggggattcttgaattgctggccaagggtgaccagctctctccgttggacatcgtggcccgcctctccatcgacaacccggccgcaccggacacgatcgaccggatgctgcggctccttgcgagttactccatcttatcgtgcactctcgtggaggataaagaaggccgcccccagaggctctacggcctcgggcctcggagcaagttctttttggaccagaatggagcttctactttaccaactcatatgctactccaagaaaagactctcctggaatgctggaactgccttaaagatgcagttaaggaaggaggggcagatcctttcacccgcaggcacggcatgaacgtgttcgactacatgggccaggacccgagattcaacgacctgtacaacaagtcgatgaggaccgggtcggcgatttacatgcccaagatcgctcagcattatcgtgggttttcaaaggcgaagacggtcgtcaatgtgggcggtggcatcggcgagaccctgaaaaccatactctccaagaatccccacatccgcgccatcaactacgacttgcctcatgtgatcgcaactgctcctcccattcctggtattacgcatgttggaggagacattctaaagtccgtccctaaagcggatgtccatttcctgaagtcggttctccatcgcggggatgatgagttctgcgtgaaggtgctcaagaattgctgggaggcattgccgccgacggggaaagtggtgatcgtggacgaggtggccccggagtatcctgagaccgacattgtctcacagaccacgctcttgatggacttgaacgccctgaggatgaccgggggcgggaagacccggacgcaaagggaattcgcggaccttgcccgcgcctcgggattccatgccccgaaatacgttctgcgcgtgtacaacctatggttgtttgagcttcacaagatgtgacgatcgcaatggtcgatggcttcttctcagtttgatgatggcttcactacgttaacaccattgtctcatgttgtcgacaagcagtggtttggtccttccaaataaaataagaatttcccctttcaaaaaaaaaa

SEQ ID NO: 196 - DNA, 1379 bp, Eucalyptus grandis
ggcaagtggtggctggaattcacacccattgcgctctctcgcccgcagcttcgattagcatgaaagccaaaagaaaagacagtcggaagaaaaaatttaaaaaaaaaaacatgagttcgaaggaagccccagtcattacaacttcccatgaagatgaagaaattttgaatgcctttgaggtcccctcaatggcttttgttcccatggtcttgaaaggcgtccatgagctggggattcttgaattgctggccaagggtgaccagctctctccgttggacatcgtggcccgcctctccatcgacaacccggccgcaccggacacgatcgaccggatgctgcggctccttgcgagttactccatcttatcgtgcactctcgtggaggataaagaaggccgcccccagaggctctacggcctcgggcctcggagcaagttctttttggaccagaatggagcttctactttaccaactcatatgctactccaagaaaagactctcctggaatgctggaactgccttaaagatgcagttaaggaaggaggggcagatcctttcacccgcaggcacggcatgaacgtgttcgactacatgggccaggacccgagattcaacgacctgtacaacaagtcgatgaggaccgggtcggcgatttacatgcccaagatcgctcagcattatcgtgggttttcaaaggcgaagacggtcgtcaatgtgggcggtggcatcggcgagaccctgaaaactcatacttccaagaatccccacatccgcgccatcaactacgacttgcctcatgtgatcgcaactgctcctcccattcctggtattacgcatgttggaggagacattctaaagtccgtccctaaagcggatgtccatttcctgaagtcggttctccatcgcggggatgatgagttctgcgtgaaggtgctcaagaattgctgggaggcattgccgccgacggggaaagtggtgatcgtggaggaagtgaccccggagtatcctgggaccgacgatgtctcacagaccacgctcttgatggacttgaacttgctgaggacaacccccagcgggaaggcccggacgcagagggaattcgcggaccttgcacgcgcctcggggttccatgccccaaaatacgttctgcgcgtgtacaacctgtggttgattgagcttcacaagaagatgtgacgatcgcaatggtcgatagcttcttctcagtttgaggatggcttcactacgttaacagatgcattacttatggtcggagtgttggtggtaatttgatgcagagacgccattgtcttatgttgtcaccaaacagtggtttggtccttccaaataaaataagaatttccccattctcttttcaattta

SEQ ID NO: 197 - DNA, 1379 bp, Eucalyptus grandis; identical to SEQ ID NO: 196

SEQ ID NO: 198 - DNA, 1379 bp, Eucalyptus grandis; identical to SEQ ID NO: 196

SEQ ID NO: 199 - DNA, 1380 bp, Eucalyptus grandis
atttatccgttttatttcctctgctttcctttgctcgagtctcgcggaagagagagaagagaggagaggagagaatgggttcgaccggatccgagacccagatgaccccgacccaagtctcggacgaggaggcgaacctcttcgccatgcagctggcgagcgcctccgtgctccccatggtcctcaaggccgccatcgagctcgacctcctcgagatcatggccaaggccgggccgggcgcgttcctctccccgggggaagtcgcggcccagctcccgacccagaaccccgaggcacccgtcatgctcgaccggatcttccggctgctggccagctactccgtgctcacgtgcaccctccgcgacctccccgatggcaaggtcgagcggctctacggcttagcgccggtgtgcaagttcttggtcaagaacgaggacggggtctccatcgccgcactcaacttgatgaaccaggacaaaatcctcatggaaagctggtattacctgaaagatgcggtccttgaaggcggaatcccattcaacaaggcgtacgggatgaccgcgttcgagtatcatggcaccgacccgcgattcaacaagatctttaaccggggaatgtctgatcactccaccattactatgaagaagatactggaaacatacaagggcttcgagggcctcgagaccgtggtcgatgtcggaggcggcactggggccgtgctcagcatgatcgttgccaaatacccatcgatgaaagggatcaacttcgacctgcctcacgtgattgaagacgctccaccccttcctggtgtcaagcacgtcggaggcgacatgttcgtcagcgttccaaagggagatgccattttcatgaagtggatatgccatgactggagtgacgaccattgcgcgaagttcctcaagaactgctacgatgcgcttcccaacaatggaaaggtgatcgttgcagagtgcgtactccctgtgtacccagacacgagcctagcgaccaagaatgtgatccacatcgactgcatcatgttggcccacaacccaggcgggaaagagaggacacagaaggagttcgaggcattggccaaaggggccggatttcagggcttccaagtcatgtgctgcgctttcggcactcacgtcatggagttcctgaagaccgcttgatctgctcctctgtggtgatgttcatggttcttggatttgaaaggtcgtgaaggagcccttttctcacagttggcttcggcataccaagttcttctcataaaaggaaacaataagaagcgactgtatgatggcgcaagtggaagttacaagatttgttgttttatgtctataaagttttgagtcttctgcatactgaaaaaaaaaa

SEQ ID NO: 200 - DNA, 1380 bp, Eucalyptus grandis; identical to SEQ ID NO: 199

SEQ ID NO: 201 - DNA, 1401 bp, Eucalyptus grandis
ggagaagactcgtgagccttcccggagacaaggccatcttacttcgcaacaaattgcgtccgcactcctttctcaagaaacctagtcattcaagaagcagagcattgcaactgcaaacagccaaagcccaaacgcgtacagaaggagagagagagagagaatagaagcatgagtgcatgcacgaaccaagcaatcacgacggccagtgaagatgaagagttcttgttcgccatggaaatgaatgctctgatagcactccccttggtcttgaaggccaccatcgaactggggatcctcgaaatactggccgagtgcgggcctatggctccactttcgcctgctcagattgcctcccgtctctccgcaaagaacccggaagcccccgtaacccttgaccggatcctccggtttctcgccagctactccatcctctcttgcactctcgcccaagacacagaaggcaaccccctgaggctttacggtttgggacccaaaagcaaacacttcgtcagagcccatggcactgccacttttgctgcccccttgatgcttatgcttaccgacaatatcgtcacttctagctggtactgcttaaaagaagagattatggaaggaggagacaacttcaaacttgccaatggactgcatgtttttgagtacactaacaaagacaggaaatttaatgagatattcaacaacgcaatgcaagccccgacaaacatgtacatgagtaaaattgtggaatcttatcaaggcttcaacaacgtcaagacggtggtcgatgtaggtggcggcatgggtgcaagccttaggattttgctatccaagtacccccacattcatggcataaactttgatctacctcatgtgatcaaagaggctcctccttatcctggcatagaacatgtgggaggggacatgacaaactacattcctaaagcggacgtcattatcatgaagtggataattcacggtgcagatgacaagttatgcgtcaagctactcaaaaactgctgggaggcattgccagagaagggcaaggtcgtgatcgtggacgctgtccttccagagcatcccgaaacagatatcatcacgaggaacgccttcctagcggacatgtccgtgctgaatatcactcccagcggaaaggatcggacagagagagaatttgaggtcctggcacgtgcatccggcttcgatgctccgaaacttgtgtgtcgagcttacaacatgtgggtagtcgagttacacaaaaggatgtgatctcttctcatcataagcatgtattgagctttccctagggaattctctgtatgttcgtgttgggtttggacacttgagccagacccttaaccttgtgtgccatcttaaggaataaattagtgctgatggaaaaaaaaa

SEQ ID NO: 202 - DNA, 1296 bp, Eucalyptus grandis
gcttagtcctctcaacttcccactacaaagcgcaatctctcctactgtgcggattgaaaagaacctgagaaagaaaaaaattcaggaaacatgagttcggccgaaaccctagcggtcactaccgcccaagaagacgaagagtacttgtccgctatcaaacaaaacatgatctcgtgcgttcccctgatcttgaaggccaccatcgagctcggcatcctcaagctcttgtccgagagctctgctcagctctcgcccactcagatcgcgtcccgcctctccatcaagaaccctgatgccggtgttgccatcgaccgcatcctgcgtttgctcgccagcttctctttcctctcgtgcaccctcacgcaggacaaagccgggcggcctgagaggatttatagcctgggccccttgagcaagtactacgtgaatgaggaaggggctagcatggcgccctggttgcttatgctctttgacgaggtttccttgagatcatggttttacttaaaagatgcagtgattgagggagaaggcgaccctttcaagctggcgaacggtacgaccctctttgactacaccgggacagacccgagatacaacagctacttcaacaatgccatgaagtgtatgtctaccattttcatgggcaaattcatggacacttaccctggattcgagaatgccaaaacagttgtcgacgttggcggcggtgttggcgaatgccttaagcttatactctccaagcaccaccacctccggggcataaacttcgacctaccccatgttgtcaaaaatgggctttctcatcccggtttggagcatgtaggagggagctttgtggatgatcccatcccaaaaggagacatcctcttagcgaagtggcaattccatagtttcgcggatgatttcgtcatacagctcctgaagagatgctggaaggcattgccggcatcgggcaaggtggtggtcatagacccagtcagcccggaatacccagggacggacctagtgacccgggccacattcacttccgatatggtcatgctggcgttgcctccaggagggaaagatcggacgatgagggaagtcgaggtcgtggcccacgcgaccgggttcagctccccgaaagtgggctgccaggtcctcaacatgtgggcgcttgagctatataaaattgcctaattcacttgcttgaaaatctctcccgcatcgatcttaccttacgctatgtcgtattgtgtccaactttgcatttccaattaaataaaactgttcttgtcattgctttcaaaaaaaaaa

SEQ ID NO: 203 - DNA, 1296 bp, Eucalyptus grandis; identical to SEQ ID NO: 202

SEQ ID NO: 204 - DNA, 1453 bp, Eucalyptus grandis
attttgctggtatcctcgtagacccagctgctcaggccattgcactctctcattccatttcctctgctttcctttctccatacaaatgggttcagcaagatccgagacccaaatgacccctacacaagtctcggacgagggggcgaacctctttgccatgcagctggtgaccgcctccgttctccctagggtcctcaagaccaccatcgagctcgacctcctcgagatcatggccagggccgggccaggtgcctgccttacccccgcggaagtcgcgtcccagctcccaacccagaaccccgatgccccggtcatgctcgatcggatcttccagctgctggccagctattctgtgctcacgtgcacccttcgtgacctccccgagggcaaggttgagcggctttatggtttagctccggtgtgcaagttcctgatgaagaacgaggatgggatctcaattgccccgctcaacttgatgaaccacagcaaacttgccgtggaaagctggaactgcttaaaagatgcgattctcgacggtggaatcccgttcaacaaggcacacgggatgactgcatttgactatctaggcaccgacccgagattgaacaagaccttcaaccggttaatgtctgatctttccaccattacgatgaagaagatactagaaacgtacaacggctttgagggcctcaagacagtggttgatgttggaggcggcactggggtcgtgcttaacatgatcataaccaaatacccgtcaattaaaggcatcaacttcgacttgcctcacgtgattgaaaatgctccatcctatcatggtgtcgaccacgttggaggcgacatgttcgtcagtgttccaaagggaaatgccattatcattaagtggatatgccataattggagcgatgaagattgcgcaaagctccttaaaaactgctacgatgcgcttccggtaaatggtagggtgatcgttgcagaacacatactccccgtgtaccccgacccaagcctagcaaccaagggagtgagccacatggactgcctcatgttggcctactgccctggcgggaaagagaggacggagaaggagttcgaggctttggccaaagggacggggtttcagggcttccgagtcacgtgtcgcgctttcaactcttacatcatggaattcttgaagaccgcttgaactgtgctcttcgaggtggtgatattcacggttccttggattcgataggtcgcaaatgagccttttcttacgcagttgcctttcgatttagtgtcctaagttgtgctcataaaatgaaagaataagtaagtaactacatgatgcttggggatgagacaaaggaaaagttataggatctgtaattttatgttaataatgttaaaatatgtctcaagtttgaacccattgaataatactcggtgtaaataaattagactaaaaaaaaaa

SEQ ID NO: 205 - DNA, 1413 bp, Eucalyptus grandis
ctctctcattccatttcctcttctttcattcctcaatacaaaaatggattcagcaggatccgagacccaaatgacccctacccaagtctcggacgaggaggagaccctctttgccatgcagctggcaaccgcctccgttctccctagggtcctcaaggccaccatcgagctcgacctcctcgagatcatggccagggcggggccaggcgcctaccttacccctggggaagttgcgtcgcagctcccgacccagaaccccgatgccccagtcatgctcgatcgaatatttcggctgctggctagctattctgtgctcacgtgcactgtccgtgacctccctgagggtaaggttgagcggctttacggtttagctccggtgtgcaagttcctggtcaagaacgaggatggggtctcccttgccccactcaacttggtcaaccaagacaaactcgccgtggaaagctggtactacttgaaagatgcgattcttgaaggcggaatcccgttcaacaaggcacacgggatgaccgcatttgactatctaggtaccgacccgcgattcaacaagatcttcaaccgggcaatgtttgatttttccaccattacgatggagaagatactggaaaagtacaacggcttcgagggcctcaagacgatggttgatgttggaggtggcactggggccgtgctcaacatgatcatagctaaatacccgtcgatcaaaggcatcaacttcgacttgcctcacgtgattaaagatgctccgtcctatcccggtgtggaacacgttggaggtgacatgtttgtcagcgttccaaaaggagatgccattttcatgaagtcgatatgccataactggaacaatgaacattgcacaaagctcctcaagagttgttacgatgcgcttccgataaatgggagggtgatcgttgcagaatacatactccccgtgtacccggacccgagcctagcgaccaagggagtgatccacatggactgcatgatgttggcccactgccctggcgggaaagagaggacggagaaggagttcgaggctttggccaaaggggcgggatttcagggctttcgagtcatgtgtcgcgctttcaacacttgcgtcatggagttcttgaagacagcttgaactgtgctcttctgggtggtgatattaatggttccttggatttgataggtcgcaaatgagcctttttttacacagttgcctttcgatttagtgtcctaagttgtgctcataaaaggaaagaataaggaagtgactgtgtgatacttgggatgggaaaaggaaaagttacaggatctatgattttatgttaataattttaaaatatgtctcgagtttgagcctatattgaataatattctgtctaaataaattagattgactgcccttat

SEQ ID NO: 206 - DNA, 1518 bp, Eucalyptus grandis
caaccaaccaccagctcaccatctgcagaatccttctgtctttggccccgtataattcgaggcctcttgtctcttgtctcctcttatgttcttcatacccccgcgcgccgccccccccaagacagaagcaagctgtgagagagaaagagagagagagagagagagagagagagagagaatggaatcgctcgatgatactgaagcaaccctgagaggccaagcgcacatatggaagcacatgttcgcattcgtcgactcgatggcgctgaaatgtgcggtcgagctccgaatacctgacatcatccactcttatggtggcgggcctgtcaccctagtccagatagcctcccgcattccctccccatcccccggaaccacatacctcgcacgcatcatgagactccttgtccgcaagaacatcttctccgcgcatcgtcgccaacccgacggcagccaggagagtcacgagatgctctacagcctcaacccatcgtcaagatggctccttcagggacccgggtctgagaacagcctcgcaccgatggtgctgatggaagaccaccagtggctgatgtccccgtggcattgcctcggcgactgcgtcaggaccggtggggtcgcatttgagatagctcacggccgcaagatttgggacttcgcatcagagaatcccgagttcaaccacttgttcaacgatgggatggcgtgtacgagcaagatcttggtcaaggctattgtggaagggtataagcatggttttgagagcattggatctttggttgatgtcggcggggggaccgggggggcagtggccgagatcattaagtcgtatccacacattcaggggattaatttcgatctgcctcacgtcgttgcgacggcgccggcgcacgctggagtcactcatgttggaggagacatgtttgagaccataccacatgctgatgcagttttcatgaagtggatcatgcatgattggggcaacgaagattgcgtcaagatactaaaaaattgcagagaagcaatcccagaaaggaatggcaaggtgattatagcagaggttgtgctgaaaccagagggtgatggcatgttcgatgagatcggactagtgttcgatctgctcatgattgcacacagctcggggggtaaggagagggacgaactcgaatggaagaagatcttggaggaaggagggtttcctcgctacaacattatcaaaaccccttccatgttgtccatcattgaagcctatccactgtgattttggtcacccaaaaattataaatgtcgattaaattagagtcgtgtgattgatctctgaaagatcgagataaacaaccaaacccactcgagctctatccgtgatatgttgtttgtggtcatctacataaggctactttcatgttggatcacatgtttcctagctctttctgtactgtatatattatatggccgacataacgagatttcgtgtgctaataagtcaaattgaaactgtggttttctcgaaaaaaaaaa

SEQ ID NO: 207 - DNA, 1518 bp, Eucalyptus grandis; identical to SEQ ID NO: 206

SEQ ID NO: 208 - DNA, 1312 bp, Eucalyptus grandis
gcattatagagttgagagataataactttgcaccatggatatggtgaatggagagatgggaagccagcagctactggctcaagctcacatatggaaccacatcttcaatttcatcaattccatgtgcttgaaatgtgccattcagttaggcattcccgacaccatccaccaccatggccaacccatgaccctcgacgccttggtctctgcacttcaaattcacccctccagagctcactgtgtcgaccgcctcatgcgcatcctcgtccactccggattcttcgaacagaagaagcttgcgccggacggtcaaggcgcctacgtactcaatcgcgtgtccaagctcctccttacggacaatccctccaatgttgcgccgttcgcactgtccatgctcgaccctattttgataaacccatggcatggcttgagcgcgtggttccacaaccacgtcgagccgacgccattcgaaatggtgcgagggatgtcgttttggaggtatgctggtcaagagccggggtttaatcgcttattcaacgatggcatggctagcgatgctcgattggtggctagcatggtggttaacgagcacaaaggggtgttcgagggaataacctcgttggtcgatgtaggcggaggaactgggacgatggccaaggccatcgcgaactcctttccgcacatggaatgcacaatatttgatcttccgcatgtggtggctaatttagaagttagcgagaacgtgagatgtgttcctggggacatgtttgaggccataccacctgcagatgcaataatattgaagtggatactccatgattggagcgatgaagacgctgtgaaggtactgaagcgatgcagggaggccttaggcaaaggcgagggcaagaaaaagaaggtaattataattgaaatggtgatggacaacacgaagagcgacaaagagatggtcgaaacccagctcttctatgacatgttgatgatgaccctcgcgtcggggagggagaggaatgaagcagaatgggctaagctcttcgtcgctgctggctttggggactacaagatcacccctgtacttggcttgcgatctcttattgaggtctacccttcatgatcgattatcaatacttgccaattcatgctctagttcttatagcttgcggtaagttaaagatcaatattaaataaggcttctctaatttcagtaagggtttagcgatgtacgagcatgcgagaatggcatgattaagttgcccattcagataagcatatctagtagttgaagcaagtggctgtcgtttgaaaaaaaaaa

SEQ ID NO: 209 - DNA, 1312 bp, Eucalyptus grandis; identical to SEQ ID NO: 208

SEQ ID NO: 210 - DNA, 1420 bp, Eucalyptus grandis
gcagaacaagactcctctgatacgttgtttagtctttgtttctcggccacttactcagacctgcatgctcacctttgattataagtgcccatcgccgtctgcgatcccacccagatctgtgaatcacttccttcgtcgattcctatccacctcaaggaagcgaccgagcgcccatccaaaccgctgtccaacgcaaaagcataggaagcgaaaaatgggctccgctcaaaaccaagtacaaccctgccacgaagaagaagacccatgcctcaaagccctcctgtactctagctatcacgtcttcccagtgatcctgcacgccgccgtcgagctcgacctcttcgggatcatagcccgggccggccccggggcctacgtgtcgcctgccgaggtggtcgcccacctcccgacccagactctcgagtcgcccgagatcatcgaccgggtcctccgttgcctcgccagccactcgctcctcacgtacaagtccgagacgtttgacgaggggaggaccgtggagaggcggtacgcgatatcaccagtcgggaagtactacgtcaaggatgaggatggcggctccatcggctcgctctctctcttcgccttccaccgagccaccatcgacgtctggctccaagtcaaggaagcaatggttggaggaggcaacttgttccagaaggtccatggcaagaccatattccagtacatgaaggaggactcaaccctgaacatgtacttcaacaacgcgatggccgatctctccgcgacgcagacaaagaagatcctcgaggtctaccatgggtttgatggcatctcgactctcgttgacgttggcggtggaaaaggcgcgacccttaacatgatcgtgtcgaagtacccctcgatcaagggcatcaacttcgatttgccccaagtcatcgaacacgctcctccttatcccggcgtgcagcatgtcggaggggatatgttcgcgagcgtcccggagggcgacgcgatcatgattaagggcacgtgccacaattggagcgacgagtcgtgcataaagtttttgaagaactgttacaaggctctgccggcgaacgggaaggtgatcgtgatggacttcatcatgccggacgagccggaggagacgatggcatctaagtacgtgtcgatgctcgacaacgccatgctgattcagccgggagggaaggagaggaccgagaagcaattcgagtacttgtgcaaagaagctggattcacgggctttaaggtcgctgcccgagctgtgtctgcactgggagtgattgagttcactaagtgattggatgaaactcgacctgtctctgttttctttttccaggcggttttatgtactagcagcaaataagatattgtggaattcaatgtctgcaattaagattttcctctaaaaaaaaaa

SEQ ID NO: 211 - DNA, 1335 bp, Eucalyptus grandis
attgtccctctctactctctcgtcagtggctcctagaaacccaacaatggccaacaaccaagaacgcgaagggcgcgatcaagaggacgaagtcgggaagctggcggtccggctggctggcgcggtggtgcttccgatgaccctcaagtcggccctcgagctcggcatcattgatgccctcgtctccacgggtgggttcctctcgcccaccgagatagcgagccgggtcggcgccaagaacccgggggccccggtcctggtggaccggatgatgcgcctcctggcgagccacggcgtgatcgagtggcggttgaggaggggcgacggcaacggagatggaggggagagagagtacggtccaggacccatgtgcaggttctttgccaaggaccaagaaggtggagatgttggtcctctgtttctgctaattcacgacaaggtcttcatggagagttggtaccacttgaacgatgtcatcatggaaggaggggttccgttcgagagggcatacgggatgacggcgttcgagtatcctgccattgacgataggttcaatcaagttttcaaccgggccatggcgagtcatacttccctcatcatgaagaaaatactcgatgtctacagagggtttgaaggcatcgaagtgctggtcgatgtgggaggcggagtcgggttcaatctcaagatgatcacctccaagaatccccacatcaagggcatcaacttcgacttgcctcacgtcttggccgatgttccttcttatccaggtgtcgagcatgttggtggagatatgtttgagagtgttcctagaggagatgccattttcatgaagtggatactccatgattggagtgatgagcattgctcgaaacttctaaagaactgttttgaggctttgcctgccaatgggaaggtgatcctcgtcgaggcgattctccccgcggttccagagaggaatgtctcttcgattaatgtgttccagcaagacctcttaatgttggctcaaaatcccggcggtaaagagaggacgcagaaggagtatgaggtcctggcggtgcaggcgggattcaccggctgtgaagtcaagtgttgcgcttacaacaactgggtagtggagttccccaaaacggcgggtcattaagtctttcgaggtctattcctaattttaggatgtgtgttttgcaaaaaactcaataataaaggaaaatgttttctcagaaagcattttccatgcataagatttgttttcctttgtttggtaatgtataattgaaacgtttcctgctatttggatcccattaaaaaataatttcacactttatctcaaaaaaaaaa

SEQ ID NO: 212 - DNA, 1335 bp, Eucalyptus grandis; identical to SEQ ID NO: 211

SEQ ID NO: 213 - DNA, 1369 bp, Eucalyptus grandis
ataactccaacttaatccaatctttgtccctcctaacaacaatggacgcggcaaatagcggagagatgagcgagagcgagatcttccgagcttacgctcacgtatggacccacactttcaacttcatctcctccatgtccctcaaatgcgccatcgagctcggcatccccgacaccctccaccgctgcggccaccccatgaccctccctgaccttgccacggcattgtctgtcccggcctccaaggcagccttccttggccgcctcgtggctgtcctcgtgcacaccggcttcctctcctgccagaagcccgcccctagaaacaacccaatatcagaagacacggctgacgaactcgggtttgagtattctctcactccagcttcacgtgtcatcgtgaagggccaaccctgggacatgtcgccgatcgcaatggtcatgctcaactcattattagtggaaccatttcactgcttgagcgagtggctcaagagcgacagcgaggttggcccatcgtcgttgcggacacccttcgacatgaagcatgggaagggcctgtgggagtacgcgagccaggacgagaagctcaaccggtgcctcaacgaggggatggcgagtgatgggccgatgatggcgaggcttataatggacaagtgtggtaggcggccgtttgaggggctgaggacggcggtcgacgtggcgggaggcatcggagggctggcgagggagctggcaaaggcttttccggagatggagtggacagtactcgacctggtgcacgtggtggccggcatggaagggacgaggaatttgaagtatgtaggtggtgacatgtttgaggctatacctccggcggacgccattttgctcaagtggatattacacgactggagcgacgaagagagcgtgaaaatattgaagcggtgtaaggaagcgatcacgagcaatggcaagatgggaaaagtgatgatagtagagatagtgataggagatgaactggaggaattccataccacgaagctcttctatgacatgatgctaatggggtgtctcacaggcaaggaaaggaacgaaaaggaatgggcgaagctctttcgtgaagctggttttagtgactataagcttactcctttggcgggttttagatctctcattgaggtttatccttgatgattgagattaattggagtaactggtgccggtatatcaagcttggtttttgttggtgtggttgcattgcaattttcctttcttttttcttcttttttagcgtgatttaagagtcgtgtctttagtttgtttggtctaccattcaaggaaacctgaccttgaatatctatctatcactggattgtgcttgaaaaaaaaaa

SEQ ID NO: 214 - DNA, 1320 bp, Eucalyptus grandis
gaacacccatccaaactttgtctgatgcaaaagcatagagagcgaaaaatgagttccgctcaaaaccaagtgaaaccctgccatgaagaagaagaagaagaagacccatgcctcaaagccctcctgtactctagttctcaagtcttcccaaggatcctgcacgccgcggtcgagctcgacctcttcgggatcatagcccgagcgggccctggggcctacatgtcgccccccgaggtggccgcccacctccctgcccagacccccgagtcggccgagatcatcgaccgggtcctccgttgcctcgcgagccactcgctcctttcgtgcaagtccgagacactcgacagcgggaggactgtggagaggcggtacgcaatatcgccggccgggaagtactacgtcagggatgaggatggcagctccgtcggctcgcaagctctcttcgccttccaccgagccaccattgacgtctggctccaattcaaggaagcaatcttgggaggaggaggcaacttgttccaaaaggtccatggcaagaccattttccagtgcatgaaggaggactcgtccctgaacaagcacttcaacgacgcgatggtcggcgtctccaagatgcagacgaggaagatcctcgaggtctaccacgggttcgacgggatcaggactctagttgacgtcggcggcggaaaaggcgcaacacttaacatgattgtctcaaagtacccctcgatcaagggcatcaacttcgatttggcccaagtcatcgaacatgccccttcctatcccggcgtggagcacatcggaggggacatgttcgtgagtgtcccggagggcgacgcgatcatgattaagagcacatgccaaaactggagcgacgagtcgtgcataaagttactgaagaactgttacaaggcattgccggcgaatgggaaggtgatcgtgatggacttcataatgccagacgagccggaggatacaatggcgtctcgatacgtgtcactgctcgacaacgccatgttgatcatgccaggggggaaggagaggaccgagaagcagttcgagtacctgtgcagagaagcaggattcacaggctttaaggtcgctgcccgagctgtgtctgcactgggagtgattgaattcaccaagtgatcgaatgaaactccatgatgcttctgatacgatgttctttcttttctcgttagtctctgtcggatttgtacctctttgtccaggaccaggtgatcttaccttgtgtgcacgaagcaaataggcattgtggaattcaatgaatatgaaatgctttggaagggaaaaaaaaaa

SEQ ID NO: 215 - DNA, 1320 bp, Eucalyptus grandis; identical to SEQ ID NO: 214

SEQ ID NO: 216 - DNA, 1282 bp, Eucalyptus grandis
atccaccaaccaactcttcaatccctcatttctcaaactccacctttgatctctcagcaacagtgcagaagccaacatggatactagcgagacccaatcgatcacgacgcctgctgaggatgaggagctcgtggctgccttcgagacgtgcatcctcacggccgtccccatggtgttgaggtctgccgtcgagcttgggatcattgacttgctagcccgggaaggcggggcctccgcccagctctcgccgtcccagatcgcagcccacctcgggatcgccaacccggacgccccacgcaccatcaaccgcatgcttcgtctcctggcgagcttctcctacttgtcgtgcactcttcatggcgatcagagtctgtatggcctcgggccaaagagcaagtactttgtaagcagtgaagccggttctttcgcgccattgctgcgattcctccaacataagaccctcatcaacagctggtatgggttgcaggaagcagttaaaaatggaggaggcctcttcgagaatgcaaacgggacaaatatcttcgaatacgccgggaaggacccggcgctcaatacggtcttcaacaacgggatggaatccccgaccccgctttacatgaacaagatcctcgagtcgtaccgtgggtttgagggcgcaaagacgattgccgacctaggtggcggcgtcggccagaaccttcggctcatattggacaagttcccaaatctcaggggcatactctatgatctgcctcatgtgatcaaagatgcacctgcccatcctcgtatggagcgtgtcggaggagacctgttaaagtctgttccgaaagcagatatactcttcatgaagtggcttttccatggtctacgagacgatttctgcaaaatgctactccagaactgttacgaggcgctgccaccaaatggcaaggtggtcatcgtggacccgatccttcccgaataccccgagacagacatagtgtcgaggaactcgttcacctccgacatgatcatgctatacacgagccctggagaagaccggacgaggaaagagctggaggtgctcgcactttcggccggatttgacaagccaaggatcgcgtgtcgagcttacaacatgtgggtgatggagttgcacaaaaagaagtgatctctctcgagtcgctcatggcggtcgttccctaattctaggatttctctcgtgtggaaaagggaaagaattaaaaaggagtgacccgtaaaataaaagccatcttctcatgaagaagaatgtagcaccatc

SEQ ID NO: 217 - DNA, 1229 bp, Eucalyptus grandis
aaactttgtctgacgcaaaagcatagagagcgaaaaatgagttccgctcaaaaccaagtgaaaccctgccatgaagaagaagaagaagaagacccatgcctcaaagccctcctgtactctagttctcaagccttcccaaggatcctgcacgccgcggtcgagctcgacctcttcgggatcatagcccgagcgggccctggggcctacatgtcgccccccgaggtggccgcccacctccctgcccagacccccgagtcggccgagatcatcgaccgggtcctccgttgcctcgctagccactcgctcctttcgtgcaagtccgagacactcgacagcgggaggactgtggagaggcggtacgcaatatcgccggccgggaagtactacgtcagggatgaggatggcacctccgtcggctcgcaagctctcttcgccttccaccgagccaccattgacgtctggctccaattcaaggaagcaatcttgggaggaggaggcaacttgttccaaaaggtccatggcaagaccattttccagtgcatgaaggaggactcgtccctgaacaagcacttcaacgacgcgatggtcggcgtctccaagatgcagacgaggaagatcctcgaggtctaccacgggttcgacgggatcaggactctagttgacgtcggcggcggaaaaggcgcaacacttaacatgattgtctcaaagtacccctcgatcaagggcatcaacttcgatttggcccaagtcatcgaacatgccccttcctatcccggcgtggagcacatcggaggggacatgttcgtgagtgtcccggagggcgacgcgatcatgattaagagcacatgccacaactggagcgacgagtcgtgcataaagttactgaagaactgttacaaggcggtgccagcgaatgggaaggtgatcgtgatggacttcataatgccagacgagccggaggagacgatggcgtctcgatacgtttcactgctcgacaacgccatgttgatccagccaggaggaaaggagaggaccgagaagcagttcgagcacctgtgcagagaagcgggattcacaggctttaaggtcgctgcccgagctgtgtctgcactgggagtgattgaattcaccaagtgatcgaatgaaactccatgatgcttctggtatgatgttgttctttcttttcttcttagcctctgtcggatttgtacctgcccgggcggccgctc

SEQ ID NO: 218 - DNA, 1422 bp, Eucalyptus grandis
ttttatttcctctgctttcctttgctcgagtctcgcggaagagagagaagagaggagaggagagaatgggttcgaccggatccgagacccagatgaccccgacccaagtctcggacgaggaggcgaacctcttcgccatgcagctggcgagcgcctccgtgctccccatggtcctcaaggccgccatcgagctcgacctcctcgagatcatggccaaggccgggccgggcgcgttcctctccccgggggaagtcgcggcccagctcccgacccagaaccccgaggcacccgtcatgctcgaccggatcttccggctgctggccagctactccgtgctcacgtgcaccctccgcgacctccccgatggcaaggtcgagcggctctacggcttagcgccggtgtgcaagttcttggtcaagaacgaggacggggtctccatcgccgcactcaacttgatgaaccaggacaaaatcctcatggaaagctggtattacctgaaagatgcggtccttgaaggcggaatcccattcaacaaggcgtacgggatgaccgcattcgagtatcatggcaccgacccgcgattcaacaagatctttaaccggggaatgtctgatcactccaccattactatgaagaagatactggaaacatacaagggcttcgagggcctcgagaccgtggtcgatgtcggaggcggcactggggccgtgctcagcatgatcgttgccaaatacccatcaatgaaagggatcaacttcgacctgcctcacgtgattgaagacgctccaccccttcctggtgtcaagcacgtcggaggcgacatgttcgtcagcgttccaaagggagatgccattttcatgaagtggatatgccatgactggagtgacgaccattgcgcgaagttcctcaagaactgctacgatgcgcttcccaacaatggaaaggtgatcgttgcagagtgcgtactccctgtgtacccagacacgagcctagcgaccaagaatgtgatccacatcgactgcatcatgttggcccacaacccaggcgggaaagagaggacacagaaggagttcgaggcattggccaaaggggccggatttcagggcttccaagtcatgtgctgcgctttcggcactcacgtcatggagttcctgaagaccgcttgatctgctcctctgtggtgatgttcacggttcttggatttgaaaggagcccttttctcacagttggcttcggcataccaagttcttctcataaaaggaaacaataagaagcgactgtatgatggcgcaagtggaagttacaagatttgttgttttatgtctataaagttttgagtcttctgcatactgatttcacagaatgtgtaacgaaacggcgtatatggatgtgcctgaatgatggaaattgtgaaaaaaaaaa

SEQ ID NO: 219 - DNA, 1369 bp, Eucalyptus grandis
agaactgtccctctttattctctcgtcagtgctcctcgaagcccaacaatggctgacaaccaagaacgcgaagggcgcgatcaagaagaggaagtttggaagctggcggcccagctgctcggcgcggtgatgcttccgatgaccctcaagtcggccctcgagctcggcatcatcgacgccctcatctctgccggtgggttcctctcgcccgctgagatagcgagaagggtcggcgccaagaacccgagggccccggtcctggtggaccggatgatgagcctcctggcgagccacagcgtgatcgagtggcggttgaggaggggcgacggcgacggagatggaggggagagagagtacggtccgggacccgtgtgcaggttctttgccaaggacgaagaaggaggagctattggtcctctgtttctgctaacttacgacaaggtcttcatggagagttggtaccacttgaacgatgtcatcatggaaggaggggttccattcgagagggcatacgggatgacggcgttcgagtatcctgccattgacgataggttcaatcaagttttcaaccgggccatggtgagtcatacttccctcatcatgaagaaaatactcgatgtctacagagggtttgaaggcatcgaagtgctggtcgatgtgggaggcggagtcgggttcaatctcaacatgatcacctccaagcatccccacatcaagggcatcaacttcgacttgcctcacgtcttggccgatgctccttcttatccaggtgtcgagcatgttggtggagatatgtttgagagtgttcctagaggagatgccattttcatgaagtggatactccacgattggagtgatgagcattgcttgaaacttctaaagaattgttttgaggctttgcctgccaatgggaaggtgatcctcgtcgaggcgattctccccgtggttccagagagaaatgtctcttcgaacattgtgttccagcaagacctcttcatgttggctcaaaatcccggcggtaaagagaggacgcagaaggagtatgaggccctggcgctgcaggcaggattctccggctgtgaagtcaagtgctgcgcttacgacagctgggtggtggagttccccaaaacggcgggtcattaagtctttcgaggtctattcctaattttaggatgtgtgattcgccaaaaactcaataataaccgaaaatgttttgttagagagcattttccatgaataagatttgttttcctttgtttggtaatgtataattgaaatgtttcctgttgtttggatcctagtagaaaataatttcacactttatctcaacaacaaaaaaaattaaaaaacatttaatttaaaaaaaaaa

SEQ ID NO: 220 - DNA, 1011 bp, Eucalyptus grandis
agcgtctaatggttcctatttagaagttcagaaagtctctgtctttcctaccttgcggggtagtctcttcggacgtactcaaacatggagcaaggctgggacaagggcgagatcctggcaagcaaagctctctcgaagtacatattggagaccaatgcatatccgagagagcacgagcagctgaaagaactcagggaggccacggtccagaagtaccaaatccggagtataatgaacgtgccggttgatgaggggcagctgatctccatgatgttgaagctcatgaatgcgaagaagacaatcgagatcggagtcttcaccggctactctcttctgaccaccgcacttgcacttccggccgacggcaagataatagcgatagaccgggataaggaggcctatgaaattggcctgccatatatcaaaaaagccggagtcgatcataagatcaacttcatccagtcggatgctttctcggttctgaacgacctcattgtaaatagccaagaacaggggacctttgattttgcttttgtggatgcgaagaaggacgactacatgaaataccacgagctgatgctcaagctggtgaaggtcggaggaatgatcgggtacgacgacaccctgtggtttggtgcggtcgcactctccgaaaccgatgacatgggcgaccacctgaagctctggagagaccaactcagggagttcaacagcttcctggggaaggatccacgtgtcgagtgctgtcttctttctgtcggaggtggcctcacgctttgtaggcgcctctattagaaacctccttacggtccagaagcaggaggttacaaggaccttggcgagtcattggactccttacttgttgacgcaaggtccatatgatgtttcgcgaatctcgtacgtgatttgttcccgagagttcttggggaagtagcaaaagtttgacagtatttgtaatcgaccgacttataatcatgcgagaataaattttgagaacgtctaaaaaaaaaa

SEQ ID NO: 221 - DNA, 1011 bp, Eucalyptus grandis; identical to SEQ ID NO: 220

SEQ ID NO: 222 - DNA, 1097 bp, Eucalyptus grandis
caaccctggaccaggtacttttggcaggcggtccattgcccttcaaaccggtccaaaccggaccatcactgtccttatatacgttgcatcatgcctgctcatagaacttaggtcaactgcaacatttcttgatcacaacatattacaatattcctaagcagagagagagagagagagagagagtttgaatcaatggccaccgccggagaggagagccagacccaagccgggaggcaccaggaggttggccacaagtctctccttcagagtgatgctctttaccaatatattttggagaccagcgtgtacccaagagagcctgagcccatgaaggagctcagggacataacagcaaaacatccatggaacataatgacaacatcagcagacgaagggcagttcttgaacatgcttctcaagctcatcaacgccaagaacaccatggagattggtgtcttcactggctactctctcctcgccaccgctcttgctcttcctgatgacggaaagattttggctatggacattaacagagagaactatgaacttggcctgccggtcatccaaaaagccggtgttgccgacaagattgacttcagagaaggccctgctttgcctattcttgatcagttgatcgaagatgggaagcaagggtcgttcgacttcatattcgtggacgcggacaaggacaattacctcaactaccacaagaggctgatcgagcttgtcaaggttggaggcctcattggctacgacaacaccctatggaacggctccgtggttgcgccgccggacgccccgctcaggaagtatgtgaggtactacagggattttgtgctggagctcaacaaggctcttgccgctgatcctaggattgagatctgcatgctccccgtgggtgatggcatcactctctgccgtcggatcagctgagcatctaatctcaagtccttatgatcagggttcattcttaatgtagaacccacgaaaaagagagggatttatgtatatcttgttgctgtttcttttccatgaacctagaaacgggattcgcaattaaatgccaaattatgttgctgtttctcttaaaaaaaaaa

SEQ ID NO: 223 - DNA, 1095 bp, Eucalyptus grandis
ggaattcattgacgacgacaacttggggaagaagccgagcaaacgaagttgcagacgccattggaaaaaagacacgaaagagatcaagaaggagcttaagaagcatcatcaatggcagccaacgcagagcctcagcagacccaaccagcgaagcattcggaagtcggccacaagagcctcttgcagagcgatgctctctaccagtacatattggagaccagcgtctacccaagagagccagagtccatgaaggagctcagggaaataacagccaaacatccatggaacctgatgaccacatcggctgatgaagggcagttcctgaacatgctcctcaagctcatcaacgccaagaacaccatggagatcggcgtctacaccggctactctctcctcgccaccgcccttgctcttcccgatgacggaaagatcttggccatggacatcaatagggagaacttcgagatcgggctgcccgtcatccagaaggccggccttgcccacaagatcgatttcagagaaggccctgccctgccgctccttgatcagctcgtgcaagatgagaagaaccatggaacgtacgacttcatattcgtggacgccgacaaggacaactacatcaactaccacaagaggctgatcgacctggtcaaggttggcggcctgatcggatacgacaacaccctgtggaacggctccgtggtcgcgcccgccgacgcgcccctccgcaagtacgtccggtactaccgggacttcgtgctggagctcaacaaggccctcgccgtggacccgaggatcgagatctgcatgcttcccgtcggggatggcatcaccctgtgccgccgggtcagctgatcgcaccagaaaggagatctcaaaatcaagcattgatgaaatgaggaactacccttgataatttccttcctttctattttttccatcttctgtcttatattgtctttgaaccgttgagcatgtatttgtattcaaatgaacgattaaggattgaggaagaagttgctaatttggcttacaatggagctacattcaaattgtataataaaagttcatttatgctaaaaaaaaaaaaaaaaa

SEQ ID NO: 224 - DNA, 1095 bp, Eucalyptus grandis; identical to SEQ ID NO: 223

SEQ ID NO: 225 - DNA, 1095 bp, Eucalyptus grandis; identical to SEQ ID NO: 223

SEQ ID NO: 226 - DNA, 1095 bp, Eucalyptus grandis; identical to SEQ ID NO: 223

SEQ ID NO: 227 - DNA, 911 bp, Eucalyptus grandis
caacacttccgcatttcggtaaggagagcaaaaatggaagagaaaacgaaagtattttccagttccaacaaagggttattgcaaagcaaggagttgtatcagtacattttggacacaagtgtgtacccgcgtgaaccagaactgctcagggaactaagagaagtcaccgctacccatccgagggccgggatgggcactgcaccagattcaggtcagttgatggcaattctactgaaacttctgaatgctaaacggaccattgaaatcggagtcttcaccgggtactctcttctactcactgccctaaatattcccgaggatggcaagataatagccatagatgaggatcgcgcggcgtatgaaatgggtttacccattatcaagaaagccggcgtagagcacaagatcgacttcattgaatccaaggctctccaggctctagataaaataatgcaaaaacctgatagcgaagggagttttgacttcgccttcgtcgatgccgacaaggtcaactattggaattatcacgagaggttgttgaaactggtgaaagtcggtggactggccgtctacgacaacacgctgtggggagggtcggtcgcaatgcctgaagatgcagtcggacatatgctaaaggagggtcggaagttgacaatcgagttcaacaacttgctggccaaggatgctcgcgtccaaatttgtcatgcttccataggcgatggaatgactatctgcaagcgaatttcctaaagctacagcatggtcgaacctgcataattcttggtttatctgtgggtattcccctttcaccatatcccattttgcaaaatgtaatctcttgcatattccatccaaaataaatgaataaatgcaatgagataccttggccattcatcgagataaaaaaaaaa

SEQ ID NO: 228 - DNA, 1353 bp, Eucalyptus grandis
caaagatgtgacgttatctaatcagcgtctccctgcccggaaaaagccggaaaaggaactgttattttcaagcttttatttcaccacaatcacggagttatatattataccaagatttccgcgttaaccttacgccggagaaacttcatctgagtgtgtgctcttgctggttttcaacaggaacatatcgataatttatgtcatggctacacacgatatggtcggcttttccgtcgtcgttgtcctccttgccacttcggttatcaccactgcccgttgtaagctctcaccgagtcattatcaatcaacatgtccgaaagcattgtcgattgttcgagctggagtagcaaaagcaatcaagaatgagacccggacgggcgcgtccttgcttcggctgcacttccatgactgcttcgtcaatgggtgcgatgcgtcgatattgttggatgacacgcctagctttgtgggcgagaaaacagcagctccgaacaacaattccgtgagagggttcgaagtgatcgaccgcatcaaggctagtctggagaaggagtgccctggagtggtttcctgtgcagatatcgttgccctggctgctcgcgactcagtcgttcatttgggaggtccttcatggagcgtaagcttagggagaaaggattccattactgctagcaggagccttgctaacacctccatacctccacctacttctaatctcagtgctctcataaccagcttcgctgctcagggtctttcagtcaagaacatggtggctctttctggttcacataccattggcctagcgagatgcacttccttccgaggacggatctacaacgactcgaacatagatacatccttcgcccataaattgcagaagatatgtcccaagattggaaatgatagtgtccttcaaaggctagacatccaaacgccgaccttctttgacaacctttactaccacaatttactgcagaagaagggccttcttcactctgatcaagagctcttcaatggcagttctgtggattcactggtcaagaagtatgcatgcgacacaggaaaatttttccgagattttgccaaggcaatgatcaaaatgagcgaaattaggccccccaaaggaagcaatggtcaaataaggaaaaattgcaggaaagtgaactaagtatgaagctcatatatgcaatttgaaactgccacatatgaacacggtagtgaaatcagggctcgataatgtcccctgaccaatttgtcgtcatgtatctgtcttcttgactaatttgtggttgctgcttgaaaaataaaggagctcgtctcagtttctgtaacccagtattaagatcaaaaaaaaaa

SEQ ID NO: 229 - DNA, 1353 bp, Eucalyptus grandis; identical to SEQ ID NO: 228

SEQ ID NO: 230 - DNA, 1194 bp, Eucalyptus grandis
gcgtgtgctccctctcgtactgccatactcctgggccgggattcggatagggttttgcggcgatccatttctcgattcaaggggaagaatcatggggaagtcctacccgaccgtgagcgaggagtacaagaaggccgtcgagaaatgcaagaagaagctgaggggcctcatcgctgagaagagctgcgctccgctcatgctccgtatcgcgtggcactccgccggtaccttcgatgtgaagacgaagaccggaggcccgttcgggaccatgaagcacgccgcggagctcagccacggggccaacagcgggctcgacgttgccgtcaggctcttgcagccgatcaaggatcagttccccatcatcacttatgctgatttctaccagctggctggcgtcgttgctgtggaagttactggtggacctgaagttgcttttcaccccggaagagaggacaaaccacaaccacctcccgagggccgtcttcctgatgctaccaagggctgtgaccacttgagacaagtgtttggtgttcagatgggcctttctgacaaggatattgtggccctctctggtggccataccctgggaaggtgccacaaggagaggtctggatttgagggaacctggaccgcaaatcccctcatattcgacaactcgtacttcaaggaattgttgagcggagagaagaaagaacttcttcagctgccaagtgataaggctcttcttgctgaccctgttttccgccctcttgttgagaaatatgctgcggatgaagatgccttctttgaagactatgctgaagcccatctgaagctctctgagctagggtttgctgatgcctaagaaagttaaagttaaaaggttgtgggtgatgccacaatctaatgtcacatgctttttggttttagaatggaatgttctagttggtcgttagttcgggaaatcggatgccctctgttcgttttgttgaatatattaaaatttgggaatttggggactgaattctgtgaaggttatccttaagataaataaaagcacattccgcataccttatgctccttttcttttccttgatttgtcaaccatctgcctatgatcacatttggagcaatcgatgtagtagtaaatatgatgtggatgtgtttttcaagatttaatacatgcacgaagctgcattagcatcaaaaaaaaaa

SEQ ID NO: 231 - DNA, 1194 bp, Eucalyptus grandis; identical to SEQ ID NO: 230

SEQ ID NO: 232 - DNA, 1471 bp, Eucalyptus grandis
tgtgcaagaacctcatgcaaggtagaaaactcaaaattgctttggcatcaagtcaatctacctgcctgtataagtagggacccttgctcggttgatcttaccttgtgcaagaaccttagaccagacccagttcacatcatggcctcccgcttcagctctttcgttttgatttcttgtctcgtgatagcttcgtcgcctgttcatgtctcgagctctgctcacttagtgaaggggctctcgtggtccttctacgagaaaagctgtcccaaggttgagtccgtcatcaggaaacatctcaagaaggtgtttgagaaggacattggccaagctgccgggctacttcgtgtgcacttccatgactgctttgttaagggatgcgatggttcggtgttgctggatggatcggcaaatgaaccaagcgagcaggacgctccaccaaacaggagcttgagacggacagcattcaagatcattgatgacctcagtcagctcgtggagaagaaatgtggtcaagtagtctcttgtgccgacatcgccgccattgccgctcgtgattccgttttcctgtcgggcggacctgagtatgatgtgccgttgggaaggcgggatggacttacgcctgcgactgaaaatgtggtcatagagaatatacctgcaccaactgagaacgccagtgaaattctctccgccctagccaagaaaaacttcgacgctaccgacgtagtggccctctctggaggccacaccattgggcttgcgcactgcaccgcctttgagaatcggctctacccgacccaagaccccaccatggcgaagacctttgcccatgatctcaagggcgtgtgccccaccacaaactccaccaacactacggtcttggacatccgatcacccaaccgattcgacaacaagtactttgtcgatttgatgaaccgccaaggcctgttcacctcagaccaagatctgtatgaggatcccacaacgagggacatcgtcactagcttcgccgaggaccaggaattgttcttcgagaagtttgtcctagctatgacgaagatgggacaactcagtgtgttgacagggacgaaaggagaaatccgagccaactgctcggtcaggaattctgagaaccccgatctcttgaagttcgtggtggaagaggacctggagagctatgctgaattgaaatgacgtgaccccttataagtgtgggtatgtatcagctggggttaactttgtcttgctaggatttgctccttttgctccttttgcttgcttgtttatagaccgtggcggtgtctaataaattgcatcagctgtttatgagtatgtcaagaatatgtaatcagcagaagctcaaaatttgtgtcacttggcgagacgttgcgtgcgagcctactgcttgggaatttgaattcggagaactctgataattcaaaggcatgaactgcaccgatcagcaaaaaaaaaa

SEQ ID NO: 233 - DNA, 1232 bp, Eucalyptus grandis
gaagtaacttagacccagacccagaccacatcatggcctcccgtttcagctctttcgttttggtttcttttcttgtgatagctgcatcacatgttcatgttacgagctctgctcacttggtgaaggggctctcgtggtccttctacgagaagagctgtcccaaggtggagtccgtcatcaagaaacatctcaagaaggtgttcgaggaggatattggccaagctgctgggctgcttcgtctgcacttccatgactgctttgttaagggatgtgatgcttcggtgttgctggatggatcagccagtggaccaagtgagcaggacgctccaccgaaccggagcttgagaccatcagcattcaagatcatcgatgacctccgtgagctcgtggacaagaagtgtggtcgagtagtctcttgtgctgatatcgcagccattgccgctcgtgactccgttgtcctgtcaggcggacctgagtatgatgtgccgttgggaaggcgggatggactcacgtttgcgactcaaaatgtgaccttagagaatttacctgcaccaactgagaacgccagtgcaattctctccgccctagccaagaaaaacttagacgctaccgacgtagtggccctctctggaggccacaccatcgggcttgggcactgcacctcctttgagaatcggctctacccgacccaagaccccacgatggagaagacctttgcccatgatctcaagggcgtgtgccccaccacaaactccaccaacactacggtcttggacatccgatcacccaaccgattcgacaacaagtactttgtcgatttggtgaaccgccaaggcctgttcacctcagaccaagatctgtatgaggatcctgcaacgagggacattgtcactagctttgccgaggaccaggaattgttctttgagaagtttgtcctagccatgacgaagatggggcaattcggcttgttgacggggacgaaaggagaaatccgagccaactgctcagtcaggaattctgagaaccccgatctcttgaagtccgtggtggaagaggacctggagagctatgctgaattgaaatgatgtgacacattataagtgtgggtatgtatcagctggggttaactttgttatgctaggatctgtgacttttgctccttttgcttgcttgtttatagaccgtggcagtgtctaataaattgcatcagctgtttatgagtaaaaaaaaaa

SEQ ID NO: 234 - DNA, 1232 bp, Eucalyptus grandis; identical to SEQ ID NO: 233

SEQ ID NO: 235 - DNA, 1232 bp, Eucalyptus grandis; identical to SEQ ID NO: 233

SEQ ID NO: 236 - DNA, 1091 bp, Eucalyptus grandis
gctttctccttacctcttctcctcccttcgcttcctccatttctctttaccatatcgctcccactgcaacacactcgcgaaggcagaagctcgctcttcaatggcgctgccggtggtcgacacggagtacctgaaggagatcgacaaggcccgccgccacctccgcgcgctcatcgcctacaagaactgcgctccgatcatgctccggctggcgtggcacgacgccgggacctacgacgcgaggacgaagaccggcggccccaccggctcgatcaggaacgaggaggagtactcccacggcgccaatgccggcttgaagatcgctcttgatttttgcgaggatgtgaagtccaaatgtccgaggattacatatgcagatctataccagctagcaggagttgtcgcagtagaagtcactggaggtcccacaattgactttgttcctggaagaaaggattcaagagtttctccaaatgaaggaagacttccagatgctaatcaaggtcctccacatctaagggacatcttttacaggatgggcctgtcagacaaggacatagtggccttatcaggggctcatacactgggaagggcacacccggaaagatctggatttgatggtccttggactcaggaaccccttaagtttgataattcctattttgtcgagttgttgaaaggggaatcagaggggctgctgaaactgccaactgacaaggcattgctggaagatcctgcatttcgcccttatgttgagttgtatgcgaaggatgcggatgcatttttcagagattatgtaatctcgcataagaagctctctgaactggggttcacgccaagttcttcaggcagcaagacagtagcgaatggtgctgtattggcacaaggtgctgtcggagtggcagtggctgcagccgtggtgatcttgagctacttctatgaagtgcgcaagaaaatgaagtgaatgatgttttctgaattcccttcgtacctagcatatattttagtgcttaatgctgcccgcaccatatatcttcatccacaataatagtcaaagcattgccggtgcttggatggaacaagccagcaaa

SEQ ID NO: 237 - DNA, 1380 bp, Eucalyptus grandis
ggctagaaaaaagaaaaagaagaaagagaatttaacaaaacttgatagaggaatagaaatggggaagtgcactgactccattatataagaagagctcaagaactagcaaagtacgcctggtgactcgaaaaatggcatccaaagctctcatcttcttggctctcttatctttctcagctgtgtcaccgagacctgccattgcagagatcaatgaggaagacaagcctggtcttgtgatgaacttctacaaggacacctgccctcaagccgaggatatcatcaaggagcaagtgaagctcctctacaagcgccacaagaacactgcattctcctggctgaggaacatcttccatgactgtgctgttcagtcatgtgatgcttccctgctcttggattcgacgcggaggagcttgtcggagaaagaaaccgaccggagtttcggtctgaggaacttcaggtacctggacaccattaaagaagctgtggagagagaatgccctggagttgtttcttgtgcggacatcctggtcttgtctgctagagatggcatagtcgcgctaggaggccctcactttcccctgaaaactgggaggagagatggtaggaagagccgagctgatgtggtcgaacaataccttccagatcacaatgaaagcatttcagtggtgctcgacagattcgcggccatgggcatcaatacaccaggagtggttgctttactaggagctcacagcgtgggccgaacccactgtgtcaagctggttcaccggctctatccagaggtcgaccctgcgctgaacccagaccacattgagcacatgcttcacaagtgcccggatgcgatcccagacccgaaggctgtgcagtactgtgaggatgacagaggcacgccgatggtgctggacaacaattactacaggaacatactggacaataagggcttgttaatcgtggaccaccagcttgccactgacaagcggaccaagccctatgttaaagaagatgccaagagccaggactacttcttcaaggagtttgcaagggccatcaccatcctctctgagaacaaccctctcactggtgaccaaggtgagatcaggaagcagtgcaatgttgccaacaagcaccactagaaggagaagtttgctttgcctccttttgctttagctttttaggttcatcagtgggaatggataaaaagaagtgcacatgggtgtgaagattgtgcagatctcgtgaccctttttctgcaattgtttttctgctctaagttggcatagtgattgtgggttgtggtgttatctatggtggagtatgatgtatacctacttctgaatgttaatatatctattgatgctcttttgtaaaaaaaaaaaaaaa

SEQ ID NO: 238 - DNA, 1185 bp, Eucalyptus grandis
agtccacaattccaaacgatcaaaataatagtcatgatggtcctttctcacgctccttcctcgctgatggggatagcggttttcgccgcgttgttgtttctcctccatccgtcgagcgctcaattaagctcaaacttttatgccacatcatgcccgaatgtgtccaacatcgtccaaaccgtgatccagcaggcccttcaatccgacccgcgcatcaccgccagtctcctccgtctccatttccacgattgctttgttgacgggtgtgatggatcgttgttgctggacaacagcgcaaacattagcagtgagaaagacgcagctccgaatacaaattcgacaagagggttcgatgtggtggacaacatcaaatcagccatcgagagctcttgtcctgggaccgtgtcttgcgccgacattctcgccctcggtgctcaagcttctgtcgttctgtcaggaggtccatcttggacggtgctcttggggaggagggacagcttgacggcgaaccaagcaggagcgaacacatcgatacctagcccttttggttccttggctaacctcacttcccaattcgccgctgttggcttggacaccaatgaccttgtcactctttccggagctcacacctttggacgtgcacaatgcaggacattcagccctaggctctacaacttcaccaatggcggccccgatcccaccataagtccttcatacttgaccactctccaacaactttgcccacagaatggaaacggctccgtccccgccaacctcgacccgacgactgtgaacacattcgacaacaactactacgccaacctccagaacaaccaagggcttcttcagtccgatcaagagctgttctcaacatctggcgccgcaacgatctccatcgtcaacagcttcagcggcaaccagagcgccttcttccagagctttgctcaatcgatgataaacatgggaaacattagtcctctcaccggaagtagtggggagatcagatcgaattgcaggaaggtcaacgggagttgaaagctctttatttatttatttctttctttctcttttttggtgttttcgttgcgtgtatgtgatattaaagcacaatgagatttaaagatcaggcatggttgaatacatcagttctattggggagcgagccataggtttgtaaaaaaaaaa

SEQ ID NO: 239 - DNA, 1185 bp, Eucalyptus grandis; identical to SEQ ID NO: 238

SEQ ID NO: 240 - DNA, 1183 bp, Eucalyptus grandis
gcgcagttcgttattagcgtgctgaaaatggcctcgccttcttcattttcaaaggccattttgactttggcttgcgtcgtgctccttatggggggcacgcgtgctcaactttcgactgacttctacgccaaaacttgccccaagctcttcccgacggtgaagaaaatcgtgcgcgcagcgattgccaacgagacccggatgggcgcctcgcttctccgcttgttcttccatgattgcttcgtcaatggttgtgacggatcgaatctcttggacgacacacctacattcactggagagaagaatgcaatgccaaaccaaaattccttgcgagggttcgatgtcgtggacaggattaagtctgcagtggagaaagtgtgccccagtatcgtctcgtgtgctgatttgttggcgattattgctcgagactccgttgggatactgggagggccaatgtgggatgtgaagctgggaaggagagatgcaagaactgcgagccaggcagcagctaacaatagcattcctccgccaactaataacctcagcgctctcatctccagcttccaaaatcaaggcctttctctaaaggacctcgtcgctctatacggagggcacacaattgggcaagcaagatgcacaaacttccgggcaaggatctacaatgagagcaatcttgacagctcatttgcccgagtggctaagagcaactgcccaagagtcaccggcgtcggtgacaacaatctagccgggcttgacttccagagcgcgacatcattcgacaactcctactatatcaacctcatcaagaaacgaggcctcctccactccgaccagcagctcttcaacggcgggtccaccgactctttcatcaggacttacgccaaaagccaaagcaccttcttcaaggacttcgtggcctccatcatcaaaatgggcgacatcaagcccctcactggatccaacggcgagatcaggaagaaatgtaggagggttaattaattattgataaaagatgtttggtatgtttggtatgcctagcatcaataatcttcgaacatcggagaggcagaatctataatagtgtggaaagccaagagagaagcattcttatgtgctttaaagccgttgtactataggaggtttaacctttaaggtaatctcccatttcattttaacaaaaaaaaaa

SEQ ID NO: 241 - DNA, 1255 bp, Eucalyptus grandis
gcagaacttggtgaagttaggaagtatactaggcatggccatcggtgttgcactcttcagctcgcttcttgtactttcatttgtctctccaatctcttcactaagttccaattactacgacaagacctgtcccaatgctgagttgatcgtcgcaaatgctgtcaagaatgcggcaatgaaggacaaaaccgttccggctgctcttctgcggatgcattttcacgactgtttcattaggggttgcgatgcgtcggtgcttttaaactccaaaggaagcaacaaagcggagaaggatggacctcctaatgtctctctgcactcattttttgtaatcgacaatgccaaaaaggagttggaagcttcttgccccggcgtggtttcatgtgcggacatcttggcactagctgctagagattccgtcgtactgtccggaggtccgacttgggatgtgcccaagggaaggaaggatggaagaacatcaaaagccagcgagacgactcaactcccagcaccacttttcaacatttctcagctccagcagagcttctcccagagaggcctctctatggaagatctcgtcgctctttcgggaggccacacactaggattttcccactgctcctccttcgcaggcaggatccgcaacttcaacaccacgcacgacatcgacccatcgatgcacccatccctggcagcgagcctaagaggcgtgtgcccgagcaagaacaggccaaaaaacgcagggaccaccatggacccttcctcgaccaccttcgacaacacgtactacaggctgatcctccaggggaagggcctgttctcttcggaccaggccctcctggcagtgcccaagacgaaggatctggtcgagaagttcgcaggctcgcacaaggaattcacggatgcattcgtcaagtccatgatcaagatgagcagcatcacaggcggaggggaagttaggaaggactgcagggtagtcaattaagggtttcggatcatctgctgcatgatctggataatcatatttctctgttcaatttaaggtgaaaagccagcttaagcatatgtataagatttgttggaaatatacgcctgaagactaaagggcctaaagttcaaacggaagtggagagtatgtcttatagaagatgaactagattttacgaaagcttagcagttaatctttttcccatgagctctataaattcatcctaatggtggatgatgtaaaaaaaaaaaaaaataaaaaaaaaaa

SEQ ID NO: 242 - DNA, 1255 bp, Eucalyptus grandis; identical to SEQ ID NO: 241

SEQ ID NO: 243 - DNA, 1293 bp, Eucalyptus grandis
cctcgtgccgcttcatctccttctctctctaacaacaatgtcgccgccgccgtcgccgccgccgcgctgcccggccctcctccgcatcgcgccgctcctcctcgccgtcctcctcgcctcctccgccgcgcccgccgcctcccgcctcaccgccgactactacgccaagtcctgcccgcgcttccaccagatcgtccaggacaccgtcacctccaagcagatctccacccccaccaccgccgccgccaccctccgcgtcctcttccacgactgcttcggcaccggctgcgacggctccatcctcctctccgccgcgcccctcgccccgcccccggagcgcgacgccgacatcaacctctccctccccggcgacgccttcgacctcgtcgtccgcgccaagaccgccctcgagctcgcctgccccggcaccgtctcctgctccgacatcctcgtcgtcgccgcgcgggacctcgtcaccatgctcggcggtccctactacgacgtcttcctcggccgccgcgacacccggatctcccgcgcctccctcgtcgccgggctcctcccgcggcccaacatgaccatgtcggagctcctctccctcttcggcgcccgcgggttctccgcccaggagatggtggccctcgccggcgctcacaccgtggggttctcccactgcaaggagttcagctccgggatctacggcttcagcaagtcctcctcctacgacccgacctacaacccgcggttcgcgcaggggctgcagaaggcctgcgcctcctacggaaaggacccgacgctctcggtgttcaacgacgtgatgacccccaacaagttcgacaacatgtactaccagaacctgcccaaggggctgggcctgctggcgtcggatcgggggctgtacggcgacccgaggacgaggccgttcgtggagatgtacgccagggatcaggaccggttcttcaaggacttcgcgagggcgatgcagaagctgagcctctacggggtccagaccgggaggaggggcgagatcaggcgaaggtgcgatgccatcaattaagatcttcgcttcttttctcgatcgctgtcgactcttgtttttctttggtgggtgtgattgagaaagtgagatggggttgaggataatgggagaagcacgcagtggagtgggatttttatatttgtattcattttttttctgatgaggcaatatgtatacatgatgtttgtaccggagctaaaggcatttatagatgatgattattcactttttcagcaaaaaaaaaaaaaaaaaaa

SEQ ID NO: 244 - DNA, 1202 bp, Eucalyptus grandis
gtgcttcccttcctcctcctttgcttatcaacttctttttcgctgaaactgtaactccaagcgatggcttgggagagctcttcggtcagaaccgcctttttattgttgctgtctttccttctgggaacagcctcggctcagctgtccagtactttctactccacctcctgtcccagcgccctctccaccattaaatccggcgtgagctctgcggtcaaaagtgaggcccgcatgggcgcatcgctgctccgccttcacttccacgattgcttcgttaatggatgcgacgcatctgttttgttggacgacaccgcgaacttcactggggagaagaatgctaccccaaatgccaattccttacggggatttgatgtgattgacacgatcaagtcccaattggagagcgcatgccccggtgttgtgtcctgcgctgatctcttgactgtggctgcccgagattccgtcgtcgctttaggtggcccaagttggacagtcccgctaggaagaagagattcaactactgcaagccaaagtgctgctaatagcaacatccctgccccgactttgaaccttagcggcctcatcactgccttctctaacaaaggtttcaccaccaaagaaatggtggcactctcagggtcgcacacgataggtcaagcccgatgcacatctttccgggcccgtctttacaacgagaccaacatcaacaccacgttcgcaacctcgctcaaggcgaactgcccaagctccggaggtgacaacaatctctctcctctagacaccacgagcccgacgtcctttgacaatgcctactttaagaacttgcaaatccaagaaggtcttcttcactcggaccagcaattgtttagtggtggttccacggacgctcaagtgaacgcttatagcagcaattcagctactttcatgacagattttgctaacgccatggtgaagatgggtaacctcagcccgctcaccggctcaagcggacagattaggaagagttgcgggaaagtcaactaatgatttttctgggttttgcttttgctgtctctaaagttttgcttacgctctcaagcccactttgataagaaaaaggttcaatgtattgtccattgggatgtttggtcccacttttaatatttatgtatgagcacttaaaagtagtgttcatgtgatcaaattcagtattaaaaaaaaaa

SEQ ID NO: 245 - DNA, 1202 bp, Eucalyptus grandis
ggctgattagcgatactgtaaagcaatcccaatggctgctcagaagcttctctctctcctggttttccagctcgcgctcgtcgcttttattctcgacgtcgccaatgctcaaggcctcaaagtagggttctacaagaatacgtgccctcaggctgaggagatagttaagaaagcggcggcgagcttcatttctcgagccccctctcttgccgctcctctcttgaggatgcatttccatgactgcttcgtcaggggatgtgatggctctgtgctactgaattcaacatcttctaaccaagcagagaaagatgcgtttccaaacctgtcactgagaggataccaagtcatcgacgcagccaaagatgcccttgaaaaaaaatgtcctggtgttgtctcttgtgctgatattcttgctctagttgctcgtgatgcagtttccatgatgaacggtccattttggcaagtccccacaggaaggagggatggcagagtgtctaacctccaagatgccttgaacaacttgcccggtcctgctttcagcatttctgcgcttaaatcgtcctttgccgcgaagggtctcagcgtcaaagaccttgccgttctctcagggggacacaccctcggaatgtcgcactgttcctccttcacgaaccgtctgtacaacttcaccggcaagaacgacgccgacccatccatggaccccaactatgtcgctcagctcaagaccaagtgcaagccgaacgacgccaccaccatcgtcgagatggacccggggagcgccaagaagtttgacgtggactactacaccctcgtctccaagaggagaggcctcttccagtccgatgccgcgctgctcaccgacagcaccaccaacgcctacgtgcagctccagctgacgagcaaatcgacgtttgccgaagactttggcgtgtccatggtgaacatgggcaacatcggcgttctcaccggcaattcgggcgagattaggaagaaatgctatttggttaactaaccaatcaagtcgtttgtttctcaccttgaatttacaaaggttttgcatgttgtatggtattctttagtttttcctgttctgattgattcggagggtgcaatgtcggtcgaggaaaggtagtggtcaagatgctgttgctttactcttcgtcgggatgaataaatcgacaataattggcgtaaaaaaaaaa

SEQ ID NO: 246 - DNA, 1427 bp, Eucalyptus grandis
ctcatgggtattctgtcccaagagacaacaacccttcagactccacctttgtcaacaacttcaatgtccttccgacacttttctcactgatttgtcctcaagctgcgctcgttaacaaacatgccccatctcacttctcattcttcccctctaacttgctcatcgacccttttcatcgccctcatcctcatatgcagccagccgaacggatccaccgcagctgccgccgccaatgccacgggccgccaccgccagatgtcgttcgactactacgccaagtcgtgcccccaggtcgagcaactcatcgggtcggtcacgagccagcagttcaaggaagcgccggtctccgggccggccaccatccggctcttcttccatgactgcttcgttgagggatgcgacgggtcgatattgatatcgagcaagcccggaagcaaggagctggccgagaaggacgcgattgacaacaaagatttgagggcggagggattcgagacgatcgcgaaagccaagtccttggtggaaaataaatgccccggcctcgtttcttgtgctgacattcttgccattgctgccagagactttgtccacttgtccggcggtccgtattaccaagtgaagaaagggaggtgggacggtaggatctcaaaggccgcgagggtgccacctaacatccctcgggcaaactcgaccgtcgaccagctcctcaagctcttcaactccaagggcctaaccctagcggacatggtggtcctctccggtgcccacacgatcgggttcgcgcactgcgtgcagttctcgagccgcctctacaactacaagggcacgaagcggcccgacccggtgatcgacccgaggctcctgaaggccctgaggatgtcgtgcccccaatttggggggaacaaggacattgtcgcaccgttcgacgtgaccacgccatttttgtttgaccacacgtattacgcgaatctcgaggccaagttggggctgctggcctcggaccaggccttgttctcggacccgaggacgaggccggtggtgcaggatatggcgaaggataagcagaagttcttccaagcttttggggctgcaatggagaagatggggatgattggggtcaagagggggaggaagcatggggagaggaggagagattgtagttcccatgggtgaatgtccatgcttttttcttcctttgttttcaaatttcatattgttttttttcgattggatttggggtttggatttgatgagtttgattgcttggtggtgttgtagagttgtaggtgaggccttgtgaatggatgagagcggtcaagaatttaggagagtttggcatacttttgggcacattcactcgttgatgttgactttgaatttgttcatgcaactaattaggattcacttcatttaagataaaaaaaaaa

SEQ ID NO: 247 - DNA, 2463 bp, Eucalyptus grandis
gacgctttgctcgtgtatgttgcaatcctctgaattttccctaactagaaataaagagattatatacatacacgagcaaagcgctctcctccagttgtcttccttcgttcgctcatctctcctcgtacattattagcatacgacctcttgtatcggacccggatccgctatcgttaacgtacacacgttctagtgctgaatggagatggagagcaccaccggcaccggcaacggccttcacggcctctgcgccgccgggagccaccatgccgacccactgaactggggggcggcggcagcagccctcacagggagccacctcgacgaggtgaagcggatggtcgaggagtaccggaggccggcggtgcgcctcggcggggagtccctcacgatagcccaggtggcggcggtggcgagtcaggagggggtaggggtcgagctctcggaggcggcccgtcccagggtcaaggccagcagcgactgggtcatggagagcatgaacaagggaactgacagctacggggtcaccaccgggttcggcgccacttctcaccggaggacgaagcaaggcggtgctttgcagaaggaacttataaggttcttgaatgccgggatcttcggcaacggcacggagtcgtgccacaccctgcctcaatcctccacccgagccgccatgctcgtccgggtcaacaccctcctccagggctactccggcatccgttttgagatcctcgaggccatcaccaagttcctcaaccacaacatcaccccgtgcctgcccctcaggggcaccatcactgcctcaggcgacttggtccccctctcctacattgccgggctcctgacgggccggcccaactccaaggccgtcgggcctgatgggaagtccctggacgctgtcgaggccttccggctcgccgggattgacacgggcttcttcgagctgcagccaaaggaagggttggcgctcgtgaacggcacggcagtcgggtctggcctggcttccatcgtcctcttcgaggccaacatactcgcggtcctgtccgaggtcctgtcagcgatcttcgcagaggtgatgcaggggaagccggagttcacagaccacttgacgcataaattgaagcaccatcccgggcagattgagtctgcggctataatggagcacattttggatggaagcgcttacgtgaaggctgctaaaaagttgcacgagatggatccgctccagaagccaaagcaggacaggtacgctctcaggacttctccccagtggctagggccccagattgaggtgatccgagcggcaaccaagatgattgagagggaaatcaattcggtcaatgacaacccgctgatcgacgtcgcgaggaacaaggccctgcacggtgggaacttccaggggaccccgattggtgtctccatggacaacactcgcctggcgattgcgtccatagggaagctcatgttcgcgcagttctcagagcttgtcaacgacttctacaacaacgggctgccctcaaatctgtcgggcggccgcaaccctagcctggactacggcttcaagggtgcagagatcgccatggcgtcatactgctcggagctccaattcctcgccaatcccgttaccaatcatgtccagagcgcggagcagcacaaccaggatgtcaactccctaggcctgatctcatcgaggaagaccgccgaggccatcgacatattgaagctcatgtcttccactttcctggttgctcttgtgccggcagttgacctgaggcatctggaggagaacctgaagagcacggtgaagaacacggtcggcagggtggccaggaaagtcctcatggtgggcgctaatggcgagctccacccgtctcactactgtgagagggacctgctcaaagtggtcgaccgcgagcatgtgttcacctacgctgatgacgcctgcagcgccacctacccgctgatgcagaagctgaggcaagtcctggtcgaccaggcactggtgaatggcgagagcgagctgaacccgagcacttcgatcttccaaaagatcgtggccttcgaggaggagctcaaggcccagttgccgaaggacgtcgagggcgttcgagtccagtacgagacaggcaacctcgccatccccaaccagatcaaggaatgcaggtcctatccattgtacaagctggtgagggaggagctggggactgccctgctcacgggcgagggcgtgatatcccctggcgaggacttcgacaaggtcttcactgcgatctgtgctggaaaactgattgatccgctgctggagtgcctaagcggttggaacggtgctcctcttcccatctcttaggaattgtcctatattctttctccttctttttccctttccgttacttgccaagtaaatctcatgtatccaatcttttctatcaagagacgaattgtatttctaaaaaaaaaaaaaaa

SEQ ID NO: 248 - DNA, 2463 bp, Eucalyptus grandis; identical to SEQ ID NO: 247

SEQ ID NO: 249 - DNA, 2463 bp, Eucalyptus grandis; identical to SEQ ID NO: 247

SEQ ID NO: 250 - DNA, 2457 bp, Eucalyptus grandis
ctgaattttccctaactagaaataaagagattatatacatacacgagcaaagcgctctcctccagttgtcttccttcgttcgctcatctctcctcgtacattattagcatacgacctcttgtatcggacccggatccgctatcgttaacgtacacacgttctagtgctgaatggagatggagagcaccaccggcaccggcaacggccttcacggcctctgcgccgccgggagcggccatgccgacccactgaactggggggcggcggcagcagccctcacagggagccacctcgacgaggtgaagcggatggtcgaggagtaccggaggccggcggtggcgagtcaggagggggtaggggtcgagctctcggaggcggcccgtcccagggtcaaggccagcagcgactgggtcatggagagcatgaacaagggaactgacagctacggcgtcaccaccgggttcggcgccacttctcaccggaggacgaagcaaggcggtgctttgcagaaggaacttataaggttcttgaatgccgggatcttcggcaacggcacggagtcgtgccacaccctgcctcaatcctccacccgagccgccatgctcgtccgggtcaataccctcctccagggctactccggcatccgttttgagatcctcgaggccatcaccaagttcctcaaccacaacatcaccccgtgcctgcccctcaggggcaccatcactgcctcaggcgacttggtccccctctcctacatcgccgggctcctgacgggccggcccaactccaaggccgtcgggcctgatgggaagtccctggatgccgtcgaggccttccggctcgccgggattgacacgggcttcttcgagctgcagccaaaggaagggttggcgctcgtgaacggcacggcagtcgggtctggcctggcttccatcgtcctcttcgaggccaacatactcgcggtcctgtctgaggtcctgtcagcgatcttcgcagaggtgatgcaggggaagccggagttcacagaccacttgacgcataaattgaagcaccatcccgggcagattgaggctgcggctataatggagcacattttggatggaagcgcttacgtgaaggctgctaaaaagttgcacgagatggatccgctccagaagccaaagcaggacaggtacgctctcaggacttctccccagtggctagggccccagattgaggtgatccgagcggcaaccaagatgattgagagggaaatcaattcggtcaatgacaacccgctgatcgacgtcgcgaggaacaaggccctgcacggtgggaacttccaggggaccccgattggtgtctccatggacaacactcgcctggcgattgcgtccatagggaagctcatgttcgcgcagttctcagagcttgtcaacgacttctacaacaacgggctgccctcaaatctgtcgggcggccgcaaccctagcctggactacggcttcaagggtgcagagatcgccatggcgtcatactgctcggagctccaattcctcgccaatcccgttaccaatcatgtccagagcgcggagcagcacaaccaggatgtcaactccctaggcctgatctcatcgaggaagaccgccgaggccatcgacatattgaagctcatgtcttccactttcctggttgctctgtgccaggcagttgacctgaggcatctggaggagaacctgaagagcacggtgaagaacacggtcggcagggtggccaggaaagtcctcatggtgggcgctaatggcgagctccacccgtctcactactgtgagagggacctgctcaaagtggtcgaccgcgagcatgtgttcacctacgctgatgacgcctgcagcgccacctacccgctgatgcagaagctgaggcaagtcctggtcgaccaggcactggtgaatggcgagagcgagctgaacccgagcacttcgatcttccaaaagatcgtggccttcgaggaggagctcaaggcccagttgccgaaggacgtcgagggcgttcgagtccagtacgagacaggcaacctcgccatccccaaccagatcaaggaatgcaggtcctatccattgtacaagctggtgagggaggagctggggactgccctgctcacgggcgagggcgtgatatcccctggcgaggacttcgacaaggtcttcactgcgatctgtgctggaaaactgattgatccgctgctggagtgcctaagcggttggaacggtgctcctcttcccatctcttaggaattgtcctatattctttctccttctttttccctttccgttacttgccaagtaaatctcatgtatccaatcttttctatcaagagacaattgtatttcttgttttctgtttggtcctttttgtctcctcccaagtgaagaaattggagaatataagtacttgagtaaatttttaaaaaaaaaa

SEQ ID NO: 251 - DNA, 2424 bp, Eucalyptus grandis
gcctctctctctctctctctctctctctctctcccagccagttctccctcgccattctccctcgctttctcgggaaacccgaacctgcgaccgcggccggcggagatggaagtagcggcggcggcggtggtggcggcggcggcggcgcacgagaacgggaacggccacgccttgccctgcagcaacggctccgcgaagccgagggatgatccgctgggctggggggccgcggcggagtcgctggccgggagccacctcgaggaggtgaagcggatggtcggggagtaccggcggccggtgctgcggctcggcggggagaccctgaccgtggcgcaggtggcggcggcggcgaggggcgcggggctgacggtggagctgtgcgagtcggcgaggcccggggtcgaggccagcgcggagtggatcatggagagcatgtgcaaggggacggacagctacggcgtgacgaccggattcggggcgacgtcgcaccggcggaccaagcaggggggcgcgctccagaaggagctcatcagattcttgaacgccggtgtgttcggcaacggaaccgaatcttgccacacgttgccacagtcggccacgagggccgcgatgctggtgagagtcaacactcttctccagggctattctggaatcagattcgagatcctggaagccctcatcaagctcgtcaacagtggcatcacgccgtgcttgccgctccgcggctcgatctccgcctctggtgacttggtacccttttcctacatcgcgggtcttttgacgggacgtcccaattccaaagcggtcggacccgctggggagaccctcacggccaaacaagcctttgagctcgctgggatcagtggtggattcttcgagttgcagccgaaggaaggacttgcccttgtgaatgggacgggagttgggtctgccttagctgccatagtgctttttgaagctaatatgctcactgtcctctcagaagttctgtctgcaatatttgctgaagtcatgcaaggaaagccagagttcactgaccatttgacgcacaaattgaaacatcatcctggccaaatagaagctgcagctatcatggagcacattttggatggtagttcttacgtcaaggcggccaagaagttgcatgatatggacccacttcagaagccgaaacaagatcggtacgcgctgaggacttcgcctcagtggttaggtcctcaggtggaagtgatccgcccatctaccaagtccattgagcgagagatcaattcagttaatgacaaccctttgattgatgtgtcgaggaacaaggccttgcatggcggtaatttccagggcacccctgttggtgtctcgatggacaatacccggttggctatagcttctattggaaaactcatgtttgcacaattctccgagcttgtcaatgacttctataacaatgggttgccttctaatctctctggcggtcgaaaccccagcttggattatggttttaaaggtgcagagataacaatggcggcttattgctctgagcttcaattcctggccaacccggtgaccaatcatgtacaaagtgctgagcaacacaaccaggatgtgaactcattgggattgatctctgctagaaaaacagcggaagcagtcgagattctacagctgatgtcatcagcctttctagttgcactttgccaagcaatagacctgaggcatttggaagaaaacttgaagagcacggtgaagaacacggtaagccagattgccaagaaggtgttaaccatgggacccaatggagagctccatccgtcaagattctgcgagaaagatctgctcaaagtggtcgaccgtgaacatgtattcgcatacattgatgatccatgcagtgcgacttacccattgatgcagaagcttaggcaagtgctcgtcgatcacgcactagccaatggtgatgaggtgaaagcgaactcttccatcttccttaagataggtactttcgaggaggagctgaaggcccttttgcctaaagaggtagataattgccggagtgcctgcgagagtggaaatgaagctatcccaaacaggatcagggaatgcaggtcatacccgctgtacaagtttgtgcgagcagatttgggaaccgagctcttaaccggagagaaggtccggtcccccggagaggatttcgacgaggtgttcacagcaatgtgtgagggtaagttgattgatcctctgctggaatgccttaaagaatgggatggccccccccttcccatttgctagaagagtactgcctaggaagaggatggcaatttgctccttatgatgtattttgtaagttgaaaggaatgctgctgggaaaaattggggattgtgcctttttctgtataataaagtctgtggagtgctgttcttttaaaaaaaaaa

SEQ ID NO: 252 - DNA, 2590 bp, Eucalyptus grandis
ctagcttccttagcgcatgtgaatttcctttagagcaaaacacaaacaaaaaaacgccaacgcgcccttcctctctcgccagccctcacctcgatctcgatctcgatctcgtgctcgcgctcgctcgctcctcgctcgatttcgactcctcttctcaggctctcggccgctctagacgttcgcattcacacgagcacgaagatggacatggacacggcagcgtgcaacggcaagggctccctcgggctctgcacgggggcaggtggtgacccgctcaattggggcgccgctgctgcggccctcacggggagccacctcgatgaggtgaagcggatggtcgaggagtcccggcgacctgtggtccgcctcggcggtgagacgctgaccatcgcgcaggtggcggccatcgcggggcgcgaggccggcatggcggtcgagctgtcggaggcggcccgggcgggggtcaaggccagcagcgactgggtgatggagagcatgagcaagggcacggacagctacggggtcaccactggcttcggcgccacctcgcataggcggaccaagcaaggtggtgctctgcagagggagctcataaggttcttgaacgccggcatattcggcaatgggactgagtcgtgccacacgctgccccactcggcgacccgggctgcgatgctcgtgaggatcaacaccctcctccagggctactcgggcatccggttcgagatcctggagaccatggccaagctcctcaaccgcaacatcaccccgtgcctgcctctcaggggtacgataacggcctcgggcgacctggtccccttgtcctacatcgccgggcttctgacgggcaggcccaactcgaaggcggtcgggccaaacggcgagtccctgaacgctgtcgaggccttccgccttgccgggatcgagcacgggttctttgacctgcagcccaaagagggccttgcgctcgtgaatggcacggcagtcgggtctgggctcgcttccattgtcctgtacgaggcgaacatcctggccgtcctctcagaggttctgtcggccatcttcgccgaggtgatgcaagggaagccggagttcaccgaccacttgacccacaagctcaagcaccatcccggacaaattgaagctgcagctataatggagcacatcttggatgggagctcctacgtgaaggacgctcaaaagctccacgagatggaccctctccagaagccgaagcaggaccgatacgcgctccgcacgtccccgcagtggctcggcccccagatcgaagtgatcagggccgccaccaaaatgatcgagagggagatcaattctgtcaacgacaacccgctgatcgacgtctccaggaacaaggctctccatggagggaacttccaggggaccccgattggcgtttccatggacaacacccgtctcgccatcgcctccatcggcaagctcatgttcgcgcagttctccgagctcgtcaacgacttctacaacaacgggctgccctctaacctgtccgggggacggaacccaagcttggattacggcttcaagggagctgagatagccatggcctcatactgctcggagctgcagtttcttgccaaccctgtgaccaaccatgtccagagcgcggagcaacacaaccaggacgtgaactccttgggcctgatctcgtcgaggaagaccgccgaggccgtcgacgtgctgaagctcatgtcctccaccttcctggtcgccctgtgccaggccatcgacctgaggcacctggaagagaacctcaagagcgtggtcaagaacacggtgaaccaagtggccaagaaggtcctctacgtcgggtccaacggcgagctccacccgtcgcggttcagcgagaaagacctgatcaaggtggtcgaccgggagtacgtcttcgcctacatcgatgacccctgcagcgccacgtaccccctgatgcagaaactgaggcaggttctcgtggacgatgcgctggacgacgtcgaccgggagaagaaccccagcacctccatcttccagaagattgggactttcgaggaggagctcaaggcactcctcccgaaggaggtcgagaacgcgagagctcagttcgagagcgggaactcggcgatcgctaacaagatcagggggtgcaggtcgtacccattgtacaggttcgtgagggaagagctcgggaccggtttgctcacgggggagaaggtcggctcgccgggcgaggactttgatctggtgttctccgccatgtgcgagggcaagctgatcgatcctttgctggagtgcttgagggactgggatggtgctccgcttcccatctgttagaaacttttccaaatcctgaagactgcctcataatttaacttgccctaatcttggtatgtacttagagagtttttcatggtcgagaaactgcggttaaaattgtaatgtctcttatgtcttttgttcagttctttcttattcaaacaccccccctcgatgtatatttggacttggaacttcatcggtgtaacaacaatgttgaaacacgtgaaggaatacaacatacatttcgttaaaaaaaaaa

SEQ ID NO: 253 - protein, 330 aa, Pinus radiata
MESDEMKEDKKTDKIVCVTGAGGFIGSWLVKQLLAKGYTVRGAVHSNPADDGRKYEHLRELEGAKERLEIVKADILDYQALVTVIRGCHGVFHTACLISNDPERVIDPAVSGTRNVLEACAEMGVKRVVVTSSIGAVYMDPHRDSLAIVDDECWSDLDYCKQTKNWYCYAKILAEKLAWEIAEKRNLDIAVVIPCLVLGPMLQPTMNMSNFHIMKYLKGSTKTYKNLTQAYVDVRDVAEAHILVYEKPSASGQRYLCAESNLHRGDLTHMLAELFPHYPIPTKCSDEENPRKQPYKFSNQKLRDLGLSFTPMKKCLADTVACLQKKGFIQ

SEQ ID NO: 254 - protein, 326 aa, Pinus radiata
MSGRLVCVTGASGFIASWLVKLLLDRGYVVRATLRDIGNPQKTEHLRALEGANERLQLVKANLLDEGTFDAAVDGCEGVFHTASPFYLGVKDPQTEMLDPAVKGTLNVLNACAKASSIKRVVVTSSVAAVIYNFRPRSPDTVVDETWFSDVEYCKQAKAWYQLSKTLAEETAWKFAKERGIDLVTINPAMVIGRLLQPTLNTSCAAILQLMNGSSTFPNMTFGWVSVKDVAEAHILAFEVPSANGRYLLAEKVAHYSEIVKILSKLYPGCTLPTKCVDDNPFAPTFTVSKERIEKLGLKYTPIEEALRDTVESLKEKKLLNLDSNL

SEQ ID NO: 255 - protein, 325 aa, Pinus radiata
MSGRLVCVTGASGFIASWLVKLLLDRGYVVRATVRDLGNPEKTKHLHVLEGAKERLQLVKANLLEEGTFDAAVDGCEGVFHTASPFYTSIKDPQAEMLDPAVKGTTNVLNACAKASSVKRVIVTSSVAAVIFNSRPRSPGVVDETWFSDAEYCKQTKAWYQLSKTLAEETAWKFAKEKGIDVVTINPAMVIGTLLQPTLNTSCAAILQIMNGSSTYPNATFGWVSVKDVANAHILAFEVPSANGRYLLVERVAHLSEIVKILSKLYPGCALPTKCADDNPFVPTYTVSKEKIEKLGLNYTPIEEALRDTVESLKEKKLLNLDSNL

SEQ ID NO: 256 - protein, 320 aa, Pinus radiata
MGESVCVTGASGFIGSWVVRLLLERGYSVHATVQDLGNWKETKHLEAMEGAKERLKLFKMDLMDYSSIQDAIDGCAGVFHLAMPNTIDAVADPQKQLLDPGIKGTINVLEAAHKAKVRRVVLTSSISAIIPNPKWPAGKPLDENCWTDLDYCRENGIWYTVAKTLAEKAAWEFSKEKGLDVVAINRGTALGPILPPEMNASLAMIVKLLQGSNEEYRNFFMGCAHVKGYCESPNTTIETPSASGRHLCVETIAHWSDFADLTAKLYPEYNVHKFTSVTQPGLVRVGNPPKKLSDLGLQFTSMEQIIKDCVSTLREKGLLV

SEQ ID NO: 257 - protein, 314 aa, Pinus radiata
MPVFPSGLDPSEDNGKLVCVMDASSYVGLWIVQGLLQRGYSVHATVQRDAGEVESLRKLHGDRLQIFYADVLDYHSITDALKGCSGLFYTFEHPQSAAGYDEVMAEIEVQAAHNALEACAQTETIEKVVFTSSVAAAIWREDGDYKVNALDERHWSDANLCRKLKLWYALAKTLSEKAAWALAMDRGLNMVTINASLIVGPGITYKSSGSTIAYLKGAAQMYEKGTLASVDIRFLADAHICAYEDPSAYGRYICFNQIVSNAEDAVNLAQSLRHLIPFPDRFEDSTVYQQRLSNKKLTGLMVGYGNRATLSSEL

SEQ ID NO: 258 - protein, 320 aa, Pinus radiata
MDAYLEENGYGASNSRKLMCLTGGWSFLGIHIARMLLGRGYSVRFAIPVTPEEAGSLMESEEALSGKLEICQADLLDYRSVFGNINGCSGVFHVPAPCDHLDGLQEYPTDSIDYEVQSALNVVEACAAAESVKRLVFTSSVSAIVCGRRTGNLGDGEIMDEKCWTNPEFCREKKLWSPLAKTLSEKAVWALSNDRDLNLVVVNPASVIGPQLSNPNSHTILNQLKGSKALQQNGISAICAYVDVEEAALAHVAAFECENATGRYICLQRVFTEDEIKEVMWSSHMTSNYRLESLLHPEKPLNLSNEKFLKLKRQYSGELA

SEQ ID NO: 259 - protein, 357 aa, Pinus radiata
MAIVKTAPICPGHHDWNRLPKEIKPDTFRSSSPKTKMVCVTNGTSFLGLWIVRQLLLRGYMVRVTVHNTGELQRVGEMEEFALYSANNKLTGVVANVVSDSTAALCEAFDGCYGVFHTSSFIDPHGLSGYTEHMVNLEVKGAEKTVEACCMTSSVRRCVFTSSLTACVWQRYGFNEDCEFVVDEKCWSDQHLCREKKLWLALSKTMSEKAAWRVAEERGGVNLVTLCPALLTGPAFSASCASSAVAYLKGAREMYERNLLATVDVRRAAEAHVCVYEEMEIGGSGRYICFDKVITRPEDARDLEKKLNMGLGFSADENSEENRSSQYHIGSHRIFNAKLRRILDLSASGRSCRRESE

SEQ ID NO: 260 - protein, 322 aa, Pinus radiata
MGSKETVCVTGASGFIGSWVVRLLLERGYSVRGTVQDLGNEKETRHLEAMEGAKERLELFQIDLLDYGSIETAINGSVGVFHLASPCIVEEVKNPQAQLLDPAVKGTMHVLQAAQKAKVKRLVLTSSISAIIPSPNWPADLPKDENCWTDLDYCKENGIWYPASKTLAEKAAWDFAKETGLDVVVINPGTVMGPILPPAINASMAMFLQLLQGGTEGYQNFYMGCVHVKDVAEGHILLYETPSASGRHLCVEATNHWSDFAEMVAKLYPEYKIHRFTEVTQPGLLRVQSPPKKLVDLGLVFTPMEQVIKDSVSSLNEKGFLN

SEQ ID NO: 261 - protein, 324 aa, Pinus radiata
MKQTDRTVCVTGAGGFIASWLVKMLLKRGYTVRGAVRTNPNDDGSKYEHLRALEGAKERLELVRADILDYKSLVAVIRGCHGVFHVATAMSNNPEEVIEPAVKGTKNVMEACAEMAVKRVVFTSSFGVVYLDPHRNPFAIVDEDCWSNLDYCIQTQNWYCYAKTLAEKLAWELAMKLNLELVVVIPGLVLGPKLQSTMDHGTAHIMKYLTGSAKTYANLTQVYVDVRDVAGAHILVYETPSAKGHRYVCGECNIHRGDLVGMLAKLCPLSPLPTEYTPRQSYIIYFNIFLFKLNIHIWKHVYNESNKINSVIMCTIMHAGVQTR

SEQ ID NO: 262 - protein, 341 aa, Pinus radiata
MKETNRTVCVTGAGGFIASWLVKMLLKRGYTVRGVVRTNPNDDGWKYAHLRALEGAKEKLELVRADILDYQSLVLVIRGCHGVFHVATAMSNKREEAIAPAVKGTKNVMEVCAEMGVKRVVFTSSIGAVYLDPHRNPLAIVDEDCWSNLDYCIQTSNWYCYAKTLAERSAWEVAKKLNLELVVLNPGVVLGPNLKSTMDQGTVHIMKYLTGSAKTYDNLTQVYVDVRDVAAAHILVYETPSASGHRYLCAECSIHRGDLADMLAKLCPHCPIPTECSDQINPRKQPYDFSNQKLKDLNFSFTPMINSVADTVESLHKKGLLQRHLSGWDDMDGSHRLLSRI

SEQ ID NO: 263 - protein, 324 aa, Pinus radiata
MTAGKQTEEGQTVCVTGAGGFIASWLVKLLLERGYTVRGTVRNPEDQKNAHLKQLEGAEERLTLVKADLMDYNSLLNAINGCQGVFHVASPVTDDPEEMVEPAVNGTKNVLDACAVAGVRRVVFTSSIGAVYMDPSRDYDALVDENCWSNLDYCKETKNWYCYGKTVAEKAAWERAKDKGLDLVVVNPCVVLGPVLQSSINASIIHILKYLTGSAKTYANSVQAYVHVRDVAEAHILVYESPSASGRYLCAESVLHRGDVVDLLASMFPQYPIPTKVKEDGKPRVKPWKVSNQKLKDLGLEFTPAKQCLYETVISLQEKGHISK

SEQ ID NO: 264 - protein, 349 aa, Pinus radiata
MISDQTTQSKQTDQTVCVTGAAGFIASWLVKMLLIRGYTVRAAVRTNPADDRWKYEHLRELEGAKERLELVKADILHYHSLLTVIRGCHGVFHMASVLNDDPEQVIEPAVEGTRNVMEACAETGVKRVVFTSSIGAVYMNPHRDPLAIVHDDCWSDLDYCVQTKNWYCYAKTLAEKSAWDIAKGRNLELAVINPGLALGPLLQPAMNPSTAHIMKYLTGSAKTYANLTQVYVDVRDVAEAHILVYETPSATGQRYLCAECSLHRGDLVQMLANLCPRYPLPTKCSDEINPRAQSFKFSNQKLKDLGLSFRPINQCMTETVASLHDKGFLQHLPPAWADRGGSQSILARM

SEQ ID NO: 265 - protein, 321 aa, Pinus radiata
MRSDQAVCVTGAGGFIASWVVKKLLSKGYTVRGAVRGNPEDGKYEHLRELDGAKERLQLVKADILDYQSLVTVIRGCHGVFHMACLLNDDPNQVIEPAVEGTRNVMEACAEMGVKRVVFTSSIGAVYMNPHRDPRAIVDDECWSDLDYCMHTNNWYCYAKTLAEKSAWEIAERRNLDMVVINPCLVLGPLLQSTMNASTGHIMKYLTGSAKTYANLTQAYVDVRDVAGAHILVYEARSAGGQRYLCGDCSLHRGELVDMLAKLCPRCPVPTKCSDEINPRKQPYKFSNRKIRDLGLSFMPIDKSLADTVASLQERGFLHHL

SEQ ID NO: 266 - protein, 329 aa, Pinus radiata
MDEKVVCVTGGSGFIGSWLVRQLLERGYTVHATLQNLSDPKERDHLEALEGAKDRLKLFQLDVLDYDSMAAAINGCQGVFHLASPCTLEELKDPQVELLDPAVKGTLNALEASRRAQVKRVVLTSSISSLVPNPNWPPNTVIDENSWTDIEYCERDKIWYPVSKTLAEKAAWEYTNTHKMDMLSIHPSTCLGPLLQPRLNASSGVLLQLLQGTQDTQSNYWLGCVHVADVAKAQILLYETPSASGRYLCTNGIIHFSDFAEVVAKICPEYPVHRFTEETQPGLVRCKDAAKKLIGLGLNFTPIEEAIQQSVASMRERGFLKEIPKAYKV

SEQ ID NO: 267 - protein, 353 aa, Pinus radiata
MQRQVRDEANRIMDGVVARKCKVCVTGAGGYIASWLVKNLLMTGYSVNATFRDPGNDSKTRHILCLPGAKERLRLFKADLRQEGSFHAAVEGCEYVFHLATPMDFAIEAQTQTNVIDAEVNGTLDILRTCSQAKSVRRVIYTSSITAASPLNDDGEFRDCLDESCWTPIDIMRREKPIFWMYYVAKTLAEQAALQYGSEDHGIEVVTIAPAIVAGPFLTPTLPASIEQALPFITGNAEHFEWLRELHDIMGSILLVHTEDACNAHIFLMEHPSARGRYICSSPPLTLREMEDFCAKRYPQFSLPLKFHIKDNVLNGVPFPSRKLLDIGFTYQYELAEILDDSIEFARKIGALP

SEQ ID NO: 268 - protein, 505 aa, Pinus radiata
MKMGTMIVFLFLYINLCMAEQFVWQPGQEIDTSGLSRASFPKGFVFGTATSAYQVEGAAKSDGRGPSIWDTFITQPGIVANNATADITVDEYHLYKSDVELMVKMNMDAYRFSISWSRIFPKGAGRINYKGVQYYNNLINYLLKRGITPYANLYHYDLPEALETAYGGLLNSRVVEDYAKFAEFCFKTFGDRVKYWMTFNEPRVVAALGYDNGIFAPGRCSAPFGNCTAGNSATEPYIVAHNLLLSHATAVKIYREKYQPMQKGKIGILLDFVWYEPLTNSSEDQGAAQRSRDFHIGWFLHPITYGKYPDSMVEIVGTRLPKFTKEQSQMVKGSIDYLGVNQYTAYYMYDPKQPKQNVTDYQMDWNTGFAYARNGVPIGPRANSNWLYIVPWGLYKAVTYVKEHYGNPTMILSENGMDDPGNVTLPAGLHDTIRVNYYKSYLQNLINAVNDGANVVGYFAWSLLDNFEWKSGYTSRFGVVYVDFTTLKRYPKMSAYWFSKLLQRH

SEQ ID NO: 269 - protein, 512 aa, Pinus radiata
MPKMSTSLFFVAVTALTLTILQRSEAQCDPNSTVDFKRKSFPPGFVFGTASSAFQYEGAVKEDGRGASVWDTYSHKFGRILDFSNADTADDQYNRYRKDMELMVDLGMDAYRFSISWSRIFPNGSRDINQAGVDHYNKFIDALLEKGIKPYVTLYHWDLPQALEDAYKGWLNSNIIEDYANFAETCFEKFGDRVKNWMTFNEPHTVSVQGYDAGLFAPGRCSVLLHLFCRAGNSATEPYIVAHNILLSHAKTVDIYRTKYKAKQGGRIGIALDVIWYEPMSDSPEDIAATQRAQDFQLGWFMHPLFFGDYPASMRERVGNRLPLFSSEESNQIKGSLDFVGINHYTTYYARNNKTHITSALLNDTLSDSGVVTLPFKNGRAIGDKASSIWLYIVPQGIRSLMNYIKRRYNNPPVIITENGMDDPNNILIPLKKALNDQKRIKYHADYLSNLSAAIKEDGCNVGGYFVWSLLDNWEWAAGYTSRFGLYFVDYRHNLTRHPKASVQWFKCFLTP

SEQ ID NO: 270 - protein, 509 aa, Pinus radiata
MALTVEAPAALHLQEEESENVKEISRDKFPESFEFGVATSAYQVEGAAKGGGRGPSIWDTFSYTPGKIIDGRNGDVAVDQYHRYKEDVDLIAKMGFNVYRFSISWSRIFPDGFGAEVNKEGIAYYNNLIDTLLQKGVRPSVTLYHWDLPQKLHESMGGWLNREIVNYFALYAETCFSAFGDRVKQWITLNEPLQTAVNGYATGIFAPGRCSDRSQSPVGDSSTEPYLVAHNQLLAHAAAVDIYRKKFQDKQGGVIGITVDGEWAEPFTDAEGDKEAAQRRREFQFGWFLDPIYFGDYPAIMRKKLGDRLPQFSPDEVAVLRGSSDFLGLNHYTTRYVIPSFRDSKKDEFYVDQDIHSIAEWEGNTIGERAASEWLYIVPWGFRKVLKWLTERYNRPPIYVTENGMDDEDSEITLLDQALNDTKRVNYFKGYLKALAEAIREGADVRGYFAWSLIDNFEWGQGYTKRFGLVFVDYKDDLKRYPKSSAHWFTSFLHGTDKQACLVNGENGR

SEQ ID NO: 271 - protein, 527 aa, Pinus radiata
MSINIADMRIVGSIIVLELLILLSLSAVSAYTQHLSRNYFPPDFIFGVASSAYQYEGAAAEDGRKPSIFDTFTHRKGTTMDGGNGDVAVDQYHRYKDDIDLMSAMGVDAYRFSISWPRLIPDGKGPINPKGIEYYNNLINELLANGIQPHVTLYHFDLPQALEDSYGGFINPQIVEDFVLYADVCFREFGDRVKYWSTFNEPNIFAIIGYDGGFFPPQRCSQPFGNCTAGNSTVEPYIVGHHVLLAHSAAVELYRKKYQAKEKGWIGLVILANWMIPLTNKSTDVAATQRANDFMLGWFLDPLVLGNYPVGIRNVVGSRLPSFTEEQAQKIRGSLDFIGVNHYFTMYCFDVPRKNAPMSRDYAQDMSIGYAVERDGIPISNTTTLNGNPVLPQSMQAVLEYIEDRSHNTPILVYENGFAEPNNSSIPLSEALNDQYRIDLHRDVLSYVLAAIRNGSDIRGYFIWTLLDDFEVLTSYTWRFGLHYVDFNDNLKRYAKLSAHWYKTFLQRRDSKGSQILLNTNSFMNLS

SEQ ID NO: 272 - protein, 509 aa, Pinus radiata
MSPSLLYIAANIFLLTALQRSEAQCGPTSTVDFNRRDFPPGFVFGTASSAFQYEGAVKEDGRGPSVWDTYSHKFGHILDFSNADVAEDQYHRYREDIQLMVDMGMDAYRFSISWSRIFPNGNGDINQAGVDHYNKFIDALLQNGIEPYVTLYHWDLPQALEDAYKGWLSPKIIDDYAKFAETCFEKFGDRVKNWITFNEPHTVSVQGYDAGLFAPGRCSVLFHLFCRAGNSATEPYIVAHNILLSHAKAVDIYRTKFKAKQGGRVGMALDVIWYEPMSESPEDIAATQRAQDFQLGWFMDPLFFGDYPASMRERVGNRLPLFSSEESSQIKGSVDFVGVNHYTTYYVKHNETDIISVLLNDTLADSGSLALPFKDGKAIGDKASSIWLYIVPQGIRSLMNYIKQRYNNPPVIITENGMDDSNNIFIPLKKALKDQKRIKYLTDYLSNLAAAIKEDGCNVGGYFVWSLLDNWEWAAGYTSRFGLYFVDYKHNLTRYPKDSVQWFKCFLAP

SEQ ID NO: 273 - protein, 513 aa, Pinus radiata
MEVSVLMWVLLFYSLLGFQVTTARLDRNNFPSDFMFGTASSAYQYEGAVREDGKGPSTWDALTHMPGRIKDSSNGDVAVDQYHRYMEDIELMASLGLDAYRFSISWSRILPEGRGEINMAGIEYYNNLIDALLQNGIQPFVTLFHFDLPKALEDSYGGWLSPQIINDFEAYAEICFRAFGDRVKYWATVNEPNLFVPLGYTVGIFPPTRCAAPHANPLCITGNCSSAEPYLAAHHVLLAHASAVEKYREKYQKIQGGSIGLVISAPWYEPLENSPEERSAVDRILSFNLRWFLDPVVFGDYPQEMRERLGSRLPSISSELSAKLRGSFDYMGINHYTTLYATSTPPLSPDHTQYLYPDSRVYLTGERHGVSIGERTGMDGLFVVPRGIQKIVEYVKEFYDNPTIIITENGYPESEESSSTLQENLNDVRRIRFHGDCLSYLTAAIKNGSDVRGYFVWSLLDNFEWAFGYTIRFGLYHVDFISDQKRYPKLSAQWFRQFLQHDDQGSIRSSSSI

SEQ ID NO: 274 - protein, 357 aa, Pinus radiata
MGSLETEKTVTGYAARDSSGHLSPYTYNLRKKGPEDVIVKVIYCGICHSDLVQMRNEMGMSHYPMVPGHEVVGIVTEIGSEVKKFKVGEHVGVGCIVGSCRSCGNCNQSMEQYCSKRIWTYNDVNHDGTPTQGGFASSMVVDQMFVVRIPENLPLEQAAPLLCAGVTVFSPMKHFAMTEPGKKCGILGLGGVGHMGVKIAKAFGLHVTVISSSDKKKEEAMEVLGADAYLVSKDTEKMMEAAESLDYIMDTIPVAHPLEPYLALLKTNGKLVMLGVVPEPLHFVTPLLILGRRSIAGSFIGSMEETQETLDFCAEKKVSSMIEVVGLDYINTAMERLEKNDVRYRFVVDVAGSKLDN

SEQ ID NO: 275 - protein, 421 aa, Pinus radiata
MAMCRSALILPVDFRLIPSHFLRRHTIRTCCLHYYSFIQQSPPFIIHDSISAALQTPPRLKVSRRCGNPIPLAMATKADCEESGRTMRAMVLESPKTLLKSVMLNIPEPAEGHVRVRVSACAVCRTDLHVVDGDLDKPKLPIIPGHEIVGVVDKVGKGVDSNLFSIGKRVGIPWLGRTCGKCTYCLEGAENLCDDPAFTGYQIDGGYAEYAVAHASYCFPLPEIYSDIEVAPLLCAGLIGYRSLRKTGFKPGLDKKKRIGIYGFGAAAHIIAQVAIHEGHQIYAFTRAGDKEAQAFALRLGAIWAGDSMSLPPHELDAAILFAPVGLLVPAALKAVRKGGIVVAGGIHMSQIPAFPYSILWGERQVVSVANLTRQDALEFLELAPKACVKTETVVFPLEKANEALASLREGRLEGAAVLVP

SEQ ID NO: 276 - protein, 358 aa, Pinus radiata
MNTKEDSNVNCSGWAARDPSGVLSPYQFNRRVPGLDDISLKITHCGVCYADVAWTRNKVGDSKYPLVPGHEIVGIVKEVGINVIRFKVGDHVGVGTYVNSCQQCEYCNERMEVNCAEGSIYTFNGIDVDGTVTKGGYSSHIVVHQRYCFKIPDNLPLASAAPLLCAGITVYSPMIRHHMNHAGKSLGVIGLGGLGHMAVKFGKAFGLNVTVLSTSASKKDEALSILGADKFLLSSDKQQIEASSKTLDFIIDTASGDHPIDLYMPLLKTSGVFVIVGFPSEIKIHPDNLIIGMKSIAGSITGGTKDTQEMLDFCAKERVYPNIEVIPIQYINEALERMINKDVKYRFVIDIENSLVSN

SEQ ID NO: 277 - protein, 380 aa, Pinus radiata
MASALSPQTITCKAAVAWGPGEAMSIEEVQVAPPQLKEVRIKVVATSICRSDITLWESRGHTPIFPRIFGHEATGIVESVGEGVTDLREGDHVLTVFQGECKNCRHCKSDKSNACETLGIERNGLMHGDQKSRFSINGKPIYHFVAVSSFSEYTVVHSECVVKLSPDVPLGKISVLGCGVATGFGAAWKIANVGKGSTVVIFGLGAVGLAVAQGAKLRGASRIIGVDINPDKFERGKAFGVTEFINPSDYKQPTQEVVKEITTGGADYCFECVGDVELMRTALESCCDGWGMAVLIGVPSGKMELSAHYGPLLGGRTLKGTLLGGWKTRSELPLLVEMYMKKEIQIDEYVSHELPFADINKAYQLMKEGKCLRCVLHVGN

SEQ ID NO: 278 - protein, 356 aa, Pinus radiata
MSESYKFQGWMGVDKDATKGKMVWQEFEPKAWEERDVDVKITHCGICGSDLHTLRSGWGATDYPCCVGHEVVGTVAKVGSEVKGIKVGDRVGVGAQTDSCGECEDCKDGRTQHCAKSVGTYAAKHYNGGKSYGGYADYWRGPATCMVKIPDSIPSAEAAPMLCGGVTVWSPLKNNGAGPGKKVGVVGVGGLGHFAVLFAKALGCDEVVAIQRNTKKKDDIMKMGATKLIATDEEEDWNKKHGRSLDLIVSTVSSPKAPFAKYLQLLKPRGNFIQVGAPEDVFPPLAAFSLIGNEIKFGGSIIGSPSDIKEMLDFVEKKGIKPWIQERPMKDANKTVVDMDNGEARYRYVLVNEKHI

SEQ ID NO: 279 - protein, 505 aa, Pinus radiata
MEAQSVSVVEQRPHALLFSFPLQGHIKPFMNLAKILSSRGFYVTFASTEFVVKRLAECGESIAHRDSTVCSENDDVCNIKFETVPDGLPPHHDRSTQNLAELFQSMEENAHIHFHKLMEKLQNLREVPPVTFIVTDGLLSKTQEIANEYGVPRVAFWTTSACGFMAYFSIPLLIKKGYLPLKDECCLSSEYLDEVRITCIPGMPPLRLKELPSFCLVTDPSDFFFQNAINQVQGTLTADGLILNTFDELEGPVLEALSLHFPVYAIGPLLLSQSFHCKDKGGSSDELSLWKEESGCLTWLDTRKPCSVLYVCLGSLAVMSNEQLLEFAWGLASSNQSFLWVVRSDIVHGESAILPKEFIEETKDRGMLVGWAPQIKVLSHPSVGGFLTHSGWNSTLESISAGVPMMCWPFFAEQETNAKFVCEEWGIGMQVKKMVKREELAILVRNLIKGEEGDEMRKRIGKLKETAKRAVSEGGSSKNNLDKLLHHIFLKGMHQMIVQNVEANN

SEQ ID NO: 280 - protein, 489 aa, Pinus radiata
MAANAERRPHVLVFPFPAQGHMIPLLDLTHTLACGGLSLTVLTTPQNQPLLDPLLHKASVEGLSIQPLVIPLPPTKGLPPGYENLAQIPLHLVLLLMASFKELAHPIEDWFQQQKDSDYGFGPPVCMISDFFLGWTYDTATKLGIPRIVFHPCGAFDAILHYSLWKYMPGILESDDDEVHFLEAPHPVSFAKHQISSLGLLYKKSDPVSEFIRYSMNLNVKSWGNIINTFYDLEAVYMDQLHRVSGSPVWSVGPLFPPAMFDPKLRRTMIERGKPSSINDSLLQQWLDSRGEKSVIYICFGSQACLSNKQIEEMAAGLEATEESFIWVMRDLPSGLPADEYGALPQGFEERMEGRGLIIRGWAPQLLILSHPSVGGFLTHCGWNSTLESITMGVPLITWPLAADQYYNARLLVESLKIGVRFCEGATTVPNRDDLRIAIKRLLGREGEEMKRAEELSKAARTAVQEGGTSYRNIEALVSEIKKLILQPS

SEQ ID NO: 281 - protein, 483 aa, Pinus radiata
MGSSLVFDYSQLRVLVVPYPAQGHMNPMLQFAKRLASKNLEVTFVITEASRKSMLEAQGAVWGASEKREEIQFETISDGLAADVDRNNVEIVSDMLSKIGEVTLGNLVERLNAQGNQISCIVYDSFLAWVPKVSKKFSIPSAFFWTQSCAAYLVYYHFFIKLAAEWHEMLKTTEVIEIEGLPPLSHSDLPSFLLPANPFRSILRLGVQQFQFLPEVTWVLGNSFHEMESEENNSIKSVRPFRTVGPAIPSAFLEGRNPGETDSGANLWKTINCTDWLNRKEPARVVYVSFGSLAVLSKEQTHEIALGLKASGYPFIWVIRPSSSKEEIHNDENLPEGFLEETSDQGLIVPWCPQLEVLSHVSVGAFMTHCGWNSTLEGLSSGVPMLAVPQWSDQMLNALYIEEKWKTGLRLSKRSADGLVEKAEVEKCIRMVMETERGVEMKKNALRWKTLAREAMAEGGSSDKNIEEFIEEIATAKASSMSG

SEQ ID NO: 282 - protein, 490 aa, Pinus radiata
MIMASLMGFDYSKLHVLVVCYPAQGHINPMLQFAKLLASKNVGVTFVTTEACRKSIIEAQDAVLGGSKKREEVRFETISDGLTSDSERRDVEVVLNMLFEIGGEALGNLIERLNSEGNKISCIVLDSFLTWIPGVAKKFNIPSAFFWTQSCAVFSIYHHFIVGDMAAAWDETWETVDAIEIPGLPPLRVSDMPSFLLPSNPHPTLSRFVVEQFQSLPESTWILGNSFQELESEEINSMKLIAPIRTVGPLIPSAFLGSRNPGDTDVGANLWRSANCTDWLDRKQPASVVYVSFGSLAVLSKEQTCEIALGLKASGHHFIWVIRPSASDGGMTSYKNLPEGFLEEISEQGLVVPWCQQLQVLSHESVGAFMTHCGWNSTLESLSLGVPMLAVPQWSDQITNSTWVERKWKMGLRVNKRSADGLVEKEEVEKCVRMVMETERGVEMRENASQWKTLAREAMAEGGSSDKNIEDFIEEIAAKSLRISGSGVPI

SEQ ID NO: 283 - protein, 481 aa, Pinus radiata
MGYLQGLDYSMLHVLVVPFPGQGHINPMLQFAKRLSSKNLQVTFVTTEANRKRMLQSQDTTSEASDKRGEVRFETISDGLTSDSERGDVVIVSAMLYKVGGLMLGNLVERLNAEGNQISCIVQDSFLPWVSDVAKKFNIPSVFFWTQSCAVYAFYHHSVYGKLATSLDGTQNEAAVVEIPGLPPVSVSDLPSLVQPSNPYGSLWQLIVDQFKSLPEATWVLGNSFEELESDEIKSMKLVAPMRTVGPLIPSAFLDGRNPGDKDPGAQLWKTTNCMDWLNTKESASVVYVSFGSLSVLSKEQNHEIAFGLKASGYSFIWVMRPSSSTGNVDSDENFPEGFLNETSEQGLVVPWCPQLEVLSHESVGAFMTHSGWNSTLEGLSLGVPMLAVPQWSDQTTNSLYIAEKWKTGLRLTKRSADGLVGKEEVEKGIRTVMETESGIEMRKNALRWKTLAREAMMEGGSSDKNIEDFVEEIAHKVRLF

SEQ ID NO: 284 - protein, 485 aa, Pinus radiata
MDECEGKTGMHAILVPLPGQGHINPAMQLAKKLASKGISITFVLTQSWHNIITHAHSTKGSNAFNHAQNLGLDIRLVAIPDCLPGEFERWNKIQEFFRSLDNMESHVEELIKNLNQSSAAPVSCIVADTMLGWAVPLAKKLRLLSVSFWTQNVSVFSITYNSYLEERRAESVIHIPGVTPLQPADLPFWLTRSPDNVIARVVARCFQTVREADWVVANSFQGLEGHVVEALWEKMRVYCVGPLLPSAYLDRSDPRDSVVGTSYRVEMDCTRWLDDKPPKSVIYVSFGSLLPMSKSQIEEIAMGLKESDYSFIWVLRHSSKECTEVSSMLPDGFLKETKERGVVVPWCSQLKVLSHPSIGGFFSHCGWNSTLESIAFGLPILGFPLGVEQFTNCNLIADEWKIGLRLRSGNDTDKVIGRVEIAENVKRLMEGEEMRRAAERLRDVVKIEVREGGTSDSNLECVVEGLNAKLSENKILSTSSPNGIL

SEQ ID NO: 285 - protein, 512 aa, Pinus radiata
MENENGRRATHPHVMMLPSLGHGHLIPFMHLIPFMHLTKKLATRGFTVTFVVTFHHKSSLLKKVEAARETGLDIQMVEMEVPRDDLALGKVNSNSTRLRHELPPLLAANELMESSFERFLQRFMGGRFCSTGPPLSCLIADMLLGWASAVAKKFNIPTVCFLIGGMYSNGVIVSMSEVLPRNLRRTPSGRYIVPGLPKEVRLTGLQMLPEATELTTESAIHQFNIRVIEGNDQSWRFIANTFYDLEADFVEYFQKRGSSIVVRTIGPLLPPEAFGNSPTKIDPLVEMGVNKESEESEECLDWLDRQKEESVLYISFGSENSISSAQTEELAMGLEASRVKFVWVLRIPSDAGSKSFSSALDFLPQGFRSRMVEEEKQGFIVLGWAPQLSILAHPAIAGFLSHCGWNSVLETITMGVPMISWPLFADQYYNSKFVVDEIQIALEAPKRTEQNWLVPRDEVERIVKLLIMGERGRELRKRVRELKMAARAAVAEGGSSYSNFDLFVSEIMSLSL

SEQ ID NO: 286 - protein, 488 aa, Pinus radiata
MAPHVLVIPYPVQGHINPLIQLSEMLSSKGILVTFINTECNHSKMMKARSYHDWNSVGPNSNIHFSQVSDGLPLDFDRAANSSEFYRCIRNEMRDSVEGLIQSHLNAETGKPPFSCIISSSFLTWAFHVGKKLELPFIAFWSQSVSVYTIYRHLSMIISNCHFPPKKEDPKDIIDYIPGLPPLQPEDLPQDIQTGDASSGFHRLVVEQLSLLEETEWIIGNTVYELEREASDAVQEAAAPICSLGPFLPSVYLESECKHKEISVNSTSLSLWEEKDCSQWLDSKARSSVLYVSFGSLARMSKTQVEEIAMGLLESGQNFLWVVRPGMLGSDDDGDVLPEGFLEKTKNRALLIPWCTQLSVLSHPSLGGFFTHGGWNSTLESLSLGVPMLVFPQATDQYTHRMLVVNQWKIGLRLAKCRDDGVIERGEISRAVKLLVGSKEGEEMRRKSKEIRETIRQTTSEGGSSWINMQRLLDYIGTTSTEPVRSEI

SEQ ID NO: 287 - protein, 494 aa, Pinus radiata
MAHNSEPLHALVIPHPTQGHMNPMMQFAKNLASKGLSVTFVTTHHTQQQIIKAHSQTDQVDPIDAHNMDGDIRSAQISDGLPLDFDRSAGFSEFMRSVEKMGGELERLIHDLNETGPPVSCVIADTMLFWSLQVTKKFGIPWISFWTQPTVVYSIFYHSHLVEAQRQSHDKTSGDEVDNLIDYIPGVPTLHPRDLPSFFNETDADSLYLLDLFRKSLQSSREADWVLCNSFDDLESATVNASMKLEPPVFRVGPLLPSGYLKGESPDENMRTGTSLCTEHDCSEWLNTKPNGSVIYVSFGSLIHVSKDQLKEIAMGLRDGRQPFLWVLRPDIVASTVSDLLPDGFLDEVGSQGLVVPWCNQLQVLSHSSVAGFITHCGWNSMLEAIALGVPMLGFPFWADQFTNCKFMADEWKLGFRVSGVAHGEDNRMIDRKDISSAIRKLFTDEGNEMKKKVAAIKESARTAVRTGGSSDKNMDSFIMGLKALNAKPQGKQY

SEQ ID NO: 288 - protein, 469 aa, Pinus radiata
MESTGNCGGFHALVVPLPGQGHINPMMQLAKKLASMGISITFVLTNSWHQIITDAHFGHGVDAFAHARNLGLNIRMVAIPDCVPGEFERWSKIQQFYGSLGNMEGPVEELIHDLHRQPNVTPVSCIVADTYLTWAVPLAKKLNMLSISFWTQSISMFSILHHSELETFQAGSVIHVPGEISIQPAELGSFLKDPANTRAVVQCLERAREADWVVANSFQALEGDVVEALSEKLQVYCVGPLLPSAYLDQSVSRDFVVGTSSRVEIDCTKWLDDQRPKSVIYVSFGSLITVSARQVEEIAMGLKESSYCFMWVLRHPGPEATEVSAMLPEGFLKETKERGLIVPWCSQLKVLNHPSIGGFLSHCGWNSILESISSGIPLLGFPLGNDQYTNCRLLADERKIGLRLKSSNDTEKVVGREEIAEKVRRLMEGEELRRTAERLRDVVQMEVKNGGTSNKNLEIVANGLKTKLM

SEQ ID NO: 289 - protein, 485 aa, Pinus radiata
MELEKRSIKAHVMVLSYPATGHTNPMLQFSKNIASRGLLVTFVTFSYNHHKVIQAKDSLRRLNLPIQFECIPDGLPQDHTLDSNVNNVVFNHMRNNMDGSTLERLIHRLNTRGNAPPVCCIVYNPFLPWARQVAKKMNIPHALFWTQSTALFSIYYHFNNSSGEKWDSRQMAESVSVSIPSLPELKLGDLPSAFTDTEERLQIYLHQLDGLSDVSWVLANTFYELEAQTIDLMRSRFGVPFSSIGPCIPSAFLDGRNPHDARVGADPWTATDKVQEWLDRKPPSSVVYISFGSITVINPQQIHELALGIESSQQNFLWVIRPPPGHDDITEFFPAGFVEKTEGRGLVVSWCVQLEVLSHRSVAAFMSHCGWNSTLEALSLGVPVLTLGVWTDQTTNSKFLADVWKAGVRMRKGEDGTVGRDEIERCMRMAVDKRSKAGEEHQKNAVKWKQLAKSAMNEGGSFDTNLNEFVEDVVSIATRSFPPPS

SEQ ID NO: 290 - protein, 501 aa, Pinus radiata
MSIENVDCALHAVIVPFPAPSHVNALMNLTQLLTNRGFFITFVNTEWLHKRIVQVSAGNTNSLISSELEQRRSKIRFLCIPDGLPPEHSRLSNLGEYVRAMQKLSPALEQLIRSSGATGDDGQYSFPPITCIVTDCFMSCTDQVATNMKVPRVIFWPFCAAASICQLYTQFLVSQGHIPVKISEANNPGKVITCLPGNLPPMRPTDLMYLYRAEDPTDILLNALVYESEKQRKGDYVLVNTFEELEGRDTVTALSLNGCPALAIGPLFLPNFLQGKDCTTSLWEEDEACLSWLDMQQTASVIYVSFGGLAIKSQEQLQQLALGLECSGQPFLWVLRSDIEDGKPAVLPDGFEERTKGRALLVRWAPQVKVLAHTSVGLFLTHAGWNSTLETISMGVPVVSFPYFADQYLNCRFAKDVWEMGLDFEGVDVDDQKVVSKEEVEDRVKRMMRTKEGKQLRENAVRLKECARRAVVHGGSSFNNLNTFVNDMARKTTARSQNETK

SEQ ID NO: 291 - protein, 490 aa, Pinus radiata
MGSLGELEYNKPHVLVMPYPAQGHINPMLLFAKKLASKQMMVTFVTTEEKRVRMLQAQDSLPGASNSSMEVKFETISDGLPVDFDRSKDVDMVLDLLSKMGGLTLANLIERLNAQGNNISCIVYDSFLHWVPDVAKKFNIPVAFFWTQSCAVYSIYYNFSGGLANLRDETGKTVDAIEVPGLPLRKVSELPSFLHPSNTQESLLRLVMDQFKLLSEATWVLGNSFSELESEEINSMKSLAPIRTVGPLIPSAFLDGRNPGDTDPGAHLWKTTNCMDWLNTKEPASVVYVSFGSLAVLSKEQMHEIALGLNASGYSFLWVVRPPSSKWEINSEENLPAGFLNETSGQGLVVPWCHQLQVLSHASIGAFMTHSGWNSTLESLSLGVPMLVIPQWSDQSTNSAYVAEKWMVGMRLKERSENGLVGREEVEKCIKIVMESQLGAELRKNALLWKKLSREAMVKGGSSDRNIQEFVDEVVARAWSSSLSGQDFIV

SEQ ID NO: 292 - protein, 486 aa, Pinus radiata
MESSGGLLYSNLRVLVVPYPRQGHINPMLQFAKRLASKNLQVTFVTTEENRERMLRAQDAVPRPPNKSVNLQFETISDGLPLDFKRSKDRQMRFDMLCRMGGLTLANLIERLNAKGSNICCIVYDALLSWLPEIAKKFNIPLAFFWTQSCAVYSIYYHFKRGLAITGDGTEKPTDLIKIPGLPLLKVSDLPSFVQPSNSDGFLSRIFLDQFNSLSEATWILGNSFEGLEYEEINSMKSIAPIRTVGPLIPSAFLNVQNDDDTDFGADMWKTTNCMDWLNTKEPASVVYISFGSIAVLSAEQTEEIALGLKASGYSFIWVIRPSSSNEVINSEENLTEGFLAEISGQGLVVPWCPQLQVLSHASVGAFMTHCGWNSTLESLTMGVPLLAVPQWSDQTTNSRYIGEEWKTGLRLDKRSADGLVGKEAVEKCIRMVMEGELGAELRENALRWKKLSREAMGEGGTSNGNIEEFVKDIVGRASSSSLSSG

SEQ ID NO: 293 - protein, 579 aa, Pinus radiata
MLLCACPGVKYWLIVILLMVIQYLDIAAGKHESTTRHYKFNVRLKNVTRLCHSKPLVTVNGRYPGPTIFAREGDRVIIKLVNHVKDNVTIHWHGVRQLRSGWADGPGYVTQCPIQTGKSYVYNFTITGQRGTLWWHAHISWLRVSVYGAIIIYPKLHVPYPFPKPHKEVPVILGEWWNANTEKVIQQALQTGGGPNVSDAYTINGLPGPLYNCSNETFVLKVHPGQTYLLRIINAALNDELFLAIANHSLTVVEVDAVYVKPFQTDTLLITPGQTTNVLLTANATSGKNKQFVIAASPFVTGSGTFDNSTVAGIVSYNSHKFKNSSTIILPKLPSFNDTNFAANFSAKLKSLANSQFPALVPQKVDRKFLFTVGLGLNPCPVGVGNTTCQGPNGTKFTASVNNISFVLPSTALLQSHYFNQIKGVYKTNFPDNPPFPFNYTGTPPNNTKPMNGTRVKVIPFNTTVQLVLQDTSIAGTESHPFHLHGFNFFVVGQGVGNYNESKDAPNFNLVDPVERNTAGVPKGGWMAIRFRADNPGVWFMHCHLEIHTSWGLKMAWIVKNGKGPLQSLPPPPSDLPPC

SEQ ID NO: 294 - protein, 567 aa, Pinus radiata
MSLQPVCAFRLLFLISFVACLAAITNADVHRYTFIIEPKNITRLCKTYELVVVNGQLPGPTIHVRNGDSLIVKVYNRAKYNATIHWHGVRQLRTGWADGPGYITQCPIQPGGRYTYRFNITDQVGTLWWHAHVSWLLATVHGAFVIYPKKQSSYPFPKPHGETPLIIGEWWNADPIAVIDEALRTGGAPNLSDAYTLNGQPGDLYNCSRAGTFRFPVKQGETYLLRMVNAALNSAHFFKIAGHKFTVVAVDASYTKPYKTDIIAIAPGQTTDVLVTADQPVGRYYMAARDYNNQGTGAFDNTTTTAIFEYVGHQNTRPILPKLPYYNDTAVVTRFSTALRSLNSKDFPVDVPHSIDDSLIATVGLGLLPCEAGNTCQGPNGTRLSASMNNMSFVLPSVALLQAYYLGINGVFMRDFQSKPPLRFNYTGDNIPKRLWAPELATKVRVVTYNSTVQLVYQSTNIFVAENHPMHLHGYDFFVVGQGFGNYNPITDPIKFNLVDPPRRNTVIAPVSGWVAIRFKADNPGVWFLHCHLDDHLAWGLNMVFLVKNGRGPLATLEPPPADLPKC

SEQ ID NO: 295 - protein, 570 aa, Pinus radiata
MSLRSLCPFSAWLVFLCSLIAYLAAIPNAAIVNYTFTIEPKIVTRLCKNYTVVTVNGQLPGPTIYVHDGDTVIVETYNKAEYNATLHWHGVEQLRTPWADGPAYVTQCPIPPGGHYTYKFNITRQEGTVWWHAHYSWLRATVHGAFVMYPKEGSSYPFTKPYAEIPIIIGEWWNDNPIAVIDEAIRTGGQPNISDAYTINGQPGDLFNCSTSGTFRLSVKSGQTYLLRIVNAALNSGHFFKIAGHKITVVAVDACYTKPYKTDVLVISAGQTTDVLITANQPVGKYYMAARAYNNQAAGDFDNTTATAILEYIGAQNYTSPILPSLPAYNDTDTVTIFSRALRSLASQEHPVDVPQTIDESLISTVGLGLLPCETGNTCEGPNGTRLSASMNNISFVDPTISLLQAYYYNISGVYMTDFPSKPAVRFNYTGDDIPRKFWIPDPATKVKVLEYNSTVQLVFQSTNIFVAENHPMHLHGYNFYLVGDGYGNYNPDTDQKKFNLVDPPLRNTVIAPVSGWVAIRFKASNPGMWFLHCHLDDHFTWGLNMVFLVKNGSTPSSTIEPPPADLPAC

SEQ ID NO: 296 - protein, 586 aa, Pinus radiata
MMAPMAGAEYGIKLIIQLLVVLLAVQLVAGKTTRHYSFHVRLKNVTRLCHTKPLITVNGKSPGPKVVVREGDRVIIKVHNHVSNNVSIHWHGVRQLRSGWADGPAYITQCPIQTGQTYVYNFTVTGQRGTLWWHAHISWLRASVYGAFIIYPKRHVPYPFPKPYKEVPLILGEWWNADTEKVVNQAMQTGGGPNVSDCYTINGHPGPLYNCSAINDTFILNVVPGKTYLLRIINAALNDELFLTIANHTMTVVEVDAVYTKPVTTNTILITPGQTTNVLLTASASDYKGKQFFILASPYATGQGTFDNTTLAGILTYSKHVLFNTSHLNSSSNFTNALMPKLPVFNDTSFATNFTLKIKSLANAQYPALVPQTVDRKFYFTVSLGLNPCPKGQKCKGVNGTKFTASINNISFVMPTVALLQSHYTGKMKGIYKTNFPDNPPFPFNYTGNPPKNVTTPMNGTRAKVIPFNTTVQLVLQDTSIAGVESHPIHLHGFNFFVVGQGFGNYNETKDSPKFNLVDPAERNTVGVPSGGWVALRFRADNPGVWFMHCHLEVHTSWGLKMAWIVKNGKGPSQSILPPPPDLPPC

SEQ ID NO: 297 - protein, 573 aa, Pinus radiata
MSSDANATSFLTFLLLLLTIEITAAAASSDYSVKRFDFHVQYQNVTRLCRTKSLLTINGQFPGPTIAVNEGDSVEVKVHNDAKYNMTIHWHGVRQLGTGWSDGPAYITQCPIQKGQSYTYKFKVDGQVGALFWHAHISWQRASIHGAFTIYPRKGVPYPFPKPDAEAQILFGEWWNGDVEAIEAYANKYGGGPNVSDAYTINGQPGLLFPCSAKDTFVQHVHHGKTYLLRIVNAALNVQLFFAIANHTMTVVEIDATYTKPYTTNYILLAPGQTMSVIMATDQPNGKYIMAARPYVTSDVPFDNTTTTAILQYAGSSRSSSENLQIMPNLPDMRDTDSATNFSATLRSLNSAQYPSIVPKKIDTRLFFTVGLNLQDCPPGDSCKGYYGGRFSASVNNQSFILPQTALLQAAYNNNSGVFSRDFPSRPPLQFNYTANNLSINMNPQFSTRVNCIPYNANVELILQDTGIMGFENHPIHIHGYNFFVVGRGFGNYKPTTDPSSFNLVDPPIHNTVGVPKGGWAALRFKADNPGVWFMHCHLEVHTSWGLAMAFLVEKEGGLRQSLGPPPQDLPPC

SEQ ID NO: 298 - protein, 572 aa, Pinus radiata
MMRISSATILALVVCLTFLTVTALATDILRHTFVIEAKPVTRLCKTHDIITVNGQFPGPTLHVRNGDTLVVKVYNRAQYNATIHWHGIRQFRTGWADGPEFITQCPIRPGGSYTYRFTITEQEGTLWWHAHSSWLRASVYGALVIHPRLGTTYPFTMPHRETPIILGEWWNRNPIDVVNQATRTGAAPNISDAYTINGQPGDLYPCSTRDTFRLPIYDDEIHLLRIVNAALNQELFFSVANHKLTVVAVDASYTKPFRTKYVMLGPGQTTDVILRAARHRVGTYYMAARAYSSAQGVPFDNTTTTAILEYRTRGLPRPSSSGPVMPILPAYNDTRTATHFARGLRSLANIEHPVYVPQTVDENLFYTIGLGLFNCPNQSCGGPNGTRFTASMNNISFVLPSTFSILQAHYLGRKGIFTTGFPDNPPVQFDYTAQNVSRSLWSPVKGTKVKVLKYNAKVQIILQDTNIVNAENHPIHLHGYDFYIVGEGFGNYNPRTDPQTFNLVDPPMRNTVAVPVNGWAAIRFVADNPGAWLMHCHLDVHITWGLAMVFLVENGPTYMTTIETPPPDLPVC

SEQ ID NO: 299 - protein, 577 aa, Pinus radiata
MACFVNRTSFLCACAAFVLSLLAVIRYAQCAAPSRNSKFFEFHVQYQNTTRLCQSKPLLTVNGQFPGPTIAVNEGDNVIVKVTNHVKHNTTIHWHGVRQFRTGWADGPAYITQCPIQERQSYTYRFKVSEQRGTLLWHAHISWQRASVHGAFIIYPKQGVPYPFPKPDFEVSILLGEWWSGDPEAVEAETMRFGGGPNVSDAYTINGQPGLLYPCSDKDTFVQRVDGGKTYLLRLINAALNDELFFAIAKHNFTVVEADACYTKHYTTDCIMIGPGQTMSVLMKTDQPVGRYMMAARPYVTASVPFDETTPTAILEYKLPAQSLQLPIILPDLPAMRDTYYATKFATALRSLNSREYPSNVPQKIDHHLFFAVSLNLQDCPVDSTCKGYFGGRFSASINNQSFVHPKTALLQAAYYNISGVFSKDFPSRPPHEYNYTAPISAAQNMNPNFSTRVAVIPYNANVELILQGTSIMGFENHPIHIHGFNVYVVGQGFGNYDPNTEPASFNLVDPPLRNTVAVPTSGWAALRFKADNPGIWYMHCHLEIHTTWGLSMAFLVENGTGLAQSVLPPPPDLPPC

SEQ ID NO: 300 - protein, 557 aa, Pinus radiata
MVISKYAAAMSCLLIAVVALEVGAETRHYKFDIKFKNVTRLCHTKPIVTANGKFPGPTIYAREGDTVTVKVTNHVTYNVSIHWHGIRQLRTGWADGPAYITQCPIQTGQTYVYNFTITGQRGTLFWHAHILWLRATLYGPIVILPPKGVPYPFPKPDKEVILILGEWWNSDTETVINQAMNSGLAPNSSDSHTINGKAGPLFYCPTKDTFALSVEPDKTYLLRIINAALNQEVFFDVANHHLTVVEVDAVYTKPFETKAIVIAPGQTTNALLHTDKKAGRYFMAARVFMDAPITVDNKTATAILQYTGSSNSLNPVLPLIPALNDTAFSSNFSNALKSLNSPQYPAKVPQSIDRNLFFTVGLALNSCPTCINGSRPAASVNNITFTMPTVALLQSHYFNISGVFTTDFPDNPPATFNYTGTPPKNLQSSNGTRLSRIPFNSTVQLVLQDTSMLTVENHPVHLHGFNFFIVGRGFGNYDPKKDPAKFNLVDPPERNTVGVPTGGWTVIRFRADNPGVWFMHCHLEVHTTWGLKMAFLVENGHGPEQSILPPPKDLPQC

SEQ ID NO: 301 - protein, 559 aa, Pinus radiata
MGVSVMHIMLIAMVFLFYLAMEAEGKTRHYKFDVELKNVSRLCNTKPIVTVNGEFPGPTIYAREGDTVIVKVTNHVKYNVSIHWHGVRQLRTGWADGPAYITQCPIQTGQSYAYNFTITGQRGTLWWHAHILWLRATIHGAIVILPPKHNPYPFPKPHKEITVLLGEWWNADVEAVINEALKSGGAPNVSDAHTINGKPGPLFKCPTKDTFVVPVEHGKTYLLRIINAALNDELFFDVANHHLKVVEVDAVYTKPLETNSIVIAPGQTTNALLYANKKSGRYFMAARSFMDAPVAVDNKTATAILQYVNSNSSTDFVVMPSIPSQNDTSFATNFSNNLRSLNSARFPAKIPQTVDRHLFFTVGLALDSCPTCNNGSRVSASINNVSFVMPKISLLQAHFFNITGVFTTDFPDRPPTPFNYTGTPPKNPMTSKGTRLARIPFNSTVQLVLQGTSVLTVENHPVHLHGFNFFIVGRGFGNYDPKKDPAEFNLVDPPERNTVGVPTGGWTAIRFRADNPGVWFMHCHLEVHTTWGLKMAFVVENGDGPNQSILPPPKDLPKC

SEQ ID NO: 302 - protein, 593 aa, Pinus radiata
MLNSKTLLCLCPCPCPSRAAVKYLLIVILLVIIQYLDIASGKHWQTTRHYKFNVRQSNVTRLCNTKPLITVNGQYPGPTIFAQEGDQVIIKLVNHVKDNVTIHWHGIRQLRSGWADGPGYITQCPLQTGMSYVYNFTITRQRGTLWWHAHISWLRASVHGAIIIYPKPHVPYPFPKPYKEVPIILGEWWNADTEKVIQQALQSGGGPNVSDAYTINGLPGPLYNCSNDTFVLNVNPGKTYLLRIINAALNDELFLAIANHSMTVVEVDAVYVKPFQTDTLVITPGQTTNVLFTANATVNVGGVNQFYIAARPFATGGGTFDNSTVAGIVSYNISNSNTSSTIMMPKLPALNDTSFAANFSAKLRSLATSQFPALIPQTVDKKLFFTIGLGLNPCPKGMGNATCQAPNGTRFTASVNNISFVLPNTALLQSHYFKQMKGVYKTNFPDNPPFPFNYTGTPPNNTQAVNGTRVKVLPFNATVQLILQDTSIFSTDSHPVHLHGFNFFVVGQGVGNYNESTDAPKFNLIDPVERNTVGVPKGGWAAIRFRADNPGVWFMHCHLEVHTSWGLKMAWVVKNGKGPLQTLPPPPSDLPPC

SEQ ID NO: 303 - protein, 593 aa, Pinus radiata
MAELGLNRPHVNKMRPISAKLIFLLVVCLNLFAATAMGSIHRYTFDIESMSVTRLCRTHNIITVNGQFPGPTLHVHSGDTLIVEVRNKAQYNATIHWHGIRQFRTGWADGPEFVTQCPIRPGGSYIYKFKITGQEGTLWWHAHSSWLRATVYGALIIYPKRGTAYPYTVPDKQFPIVLGQWWNSNPIDVVNEATLTGAAPNISDAYTINGQPGDLYRDLYNCSTSDTTRIRVKAGETNLLRVINAAMNNDLFFAVANHSMTVVAVDALYTKPVQTNFLMLGPGQTTDVLVTADQSIGSYYMAARAYSSGQGVAFDNTTTTAILEYAGVNSTSSSPQMPDLPFFNDTKSMTQFNAALRSLASPQHPVSVPHTVEENLLYTVGIGLFNGTRLGASMNNFSFVLPSTVSMLQAHYFGIKGVFTENFPDNPPLQFDYTAQNISTSLWSPVKDTRVKVLKYNTTVQVVLQGTNIVAGESHPIHLHGYDFYIVGTGFGNYNARRDPKHFNLVDPPKRNTVNVPVNGWAAIRFVADNPGVWMFHCHLDVHVTWGLAMVFVVENGPDNGSSLQRPPRDLPRCSEIEQQLILPNVDSSTTTS

SEQ ID NO: 304 - protein, 568 aa, Pinus radiata
MDRILRQSSFNVLLLVLSFSLLQWIPCLCQPTTRTYDFKVQLKNITKLCNTTTIATVNGMFPGPTIYAQEDDTVIVKVTNLVSYNITLHWHGVKQKLSCWADGPRFITQCPIKTGQNYTYKFTLTGQRGTLWWHAHIAWLRATVNGAIVIYPKTGVPYPFQFPTEEHVLILGEWWGANVANLENAVMASGGGPPLSDAYLINGHPGPTYNCSAQDVWTMPVVKGKTYLMRVINAALNIEHFFSVAKHKITVVATDAEYTKPYTVDNIMIAPGNTYDILLRAYRGPNKDYYIGISPYLSANLTVNTGKSFAILSYQRNSSSSAPIIKPRFPKINDSAAVFTGMSLMKSLNSQAYPANVPQKVDRNLFFALELNLEACKRGQTCNAPNNTRFQASINNVTFQVPQTSILQAYYDNIQGVFSTDFPDNPPSPFNYTGNIMSNLQSNFGTRVSVLKYNQSVQLVLQGTNLTSAENHPVHLHGHNFFVVGYGTGNYPGPSNFNLVDPPSRNIIGVPPNGWVAIRFIADNPGVWYLHCHLEIHLTWGLSMAFLTLNGNGPNQTLPPPPPDYPKC

SEQ ID NO: 305 - protein, 577 aa, Pinus radiata
MKIHLPAEEMVLSMAACRNIVVKTMLIAMFLLPGAVQGETRHYKFNIQLKNVTRICHTKPIVTVNGEFPGPTIEAREGDTLLIKVTNHVKYNVSIHWHGVRQLRTGWADGPAYITQCPIQTGQTYIYNFTVTGQRGTLWWHAHILWLRATLYGAIVILPPPNVPYPFEPKPHKEITLVLGEWWNADVEAVINEALQTGAAPNISDAHTINGKPGEIFKCPVKDTFTLPVEHGKVYLLRIVNAALNDELFFEVANHQVKVVEVDAVYTKPFDTKAIVIAPGQTTNVLLEANKRSGSYFVAARPFMDAPVTVNNKTATAILHYIGRNSESDIPAVNPLMPRLPLLNDTAFATSFTSKLRSLNSVQFPAKVPQTIDRNLFFAVGLATESCQTCNGGLRASASINNISFVMPSISLLDAHIFNISGVFTADFPDRPPTPFNYTGTPPKNLITSKGTRLSRLPFNSTVQLVLQDTSVLTVENHPIHLHGFNFFIVGRGFGNYDPNTDPASFNLVDPPERNTVGVPTGGWTVIRFRADNPGVWFMHCHLEVHTTWGLKMAFLVENGDGPDQSILPPPSDFPKC

SEQ ID NO: 306 - protein, 519 aa, Pinus radiata
MDLGLRQWLLSESRVEFYVKLAAALFLAVLLASWGKGRKRRMPPGPFPLPIIGNLHMLGDLPHRALEKLSMKHGPLMSLRLGSVLTLVVSSPEVAREFLKTHDQLFASKNPSAAAKLLSFNYADFGFSSYSPYWRHLRKICALELLSGRRLDSLRFIREEEVSAMIRSIINSDGSRPLNINQTLASVATAIICRMAFGRNYSDQELKAFNSMVRESFLLLGSFNIGDYIPYLDWIDLQGFNRRIKKLHETQNHLLEKVIEEHVARNESNITHDLVDVLLAASADKDSEFQISRDSIKGVIFDVLLGGSDTAPTAIEWAMSEALRNPPVMKKLQDELESVVGLGRMVCESDLPKLVYLQAAVKETLRLHPSGPLLVRHLFGTASCNVLGYEIPQNTLVLVNVWAIGRNPKSWEDAEVFKPERFMEKVGSEVDANGDQNFGCLLFGAGRRRCPGQQLGTLLVEFGLAQLLHCFNWRLPLDDINGENQEVDMNEMFNGVTLRKARELSAIPTPRLECIAHLK

SEQ ID NO: 307 - protein, 516 aa, Pinus radiata
MGFDGNLVSDIVGITGGGLNAYYSLGLLALFGSWVLLLRIRPWSAKLLPPGPPALPIIGNLHMLGKLPHRNLRDIAQKYGPLMFLRFGSVPTVVASSPEMAEQFLKTHDLNFAGRPSTTVGKNMIYNSTDIGFSPYGPYWRTVRKVCVLELLSPRRLELLKFVREEEVSALLESVTKCCASGEAANVSKLVSTMTTDIICRMAFGKKYCEEDLDSRGFKDMIKEVFFLSGAINIGDFIPWLEWLDLQGLRRRQKSCHNTFDAFFEMVIEEHMEKSKGDSADNKDFVDVMLGLMDNNDMEIKITRDNIKAVIFDMLGAGTDTSSATLEWAMSEMLLNPSMMRKVQEELESVVGLDRRVEEGDLPRLPYLKAVVKETLRLHPPGPLLIPHESFNDCTVGGYFIPRKSRLIVNVWALARDPKSWEDADVFKPERFVGSPIDIKGQHFQMLPFGSGRRGCPGQPLALTVVEYTLASLLHCFDWKLPAGMKPGDLDMTEEFGLSTPRSVHLVAVPTLRLKV

SEQ ID NO: 308 - protein, 516 aa, Pinus radiata
MGFDGNLVSDIVGITGGGLNAYYSLGLLALFGSWVLLLRIRPRSAKLLPPGPPALPIIGNLHMLGKLPHRNLRDIAQKYGPLMFLRFGSVPTVVASSPEMAEQFLKTHDLNFAGRPSTTVGKNMIYNSTDIGFSPYGPYWRTVRKVCVLELLSPRRLELLKFVREEEVSALLESVTKCCASGEAANVSKLVSTMTTDIICRMAFGKKYCEEDLDSRGFKDMIKEVFFLSGAINIGDFIPWLEWLDLQGLRRRQKSCHNTFDAFFEMAIEEHMEKSKGDSADNKDFVDVMLGLMDNNDMEIKITRDNIKAVIFDMLGAGTDTSSATLEWAMSEMLLNPSMMRKVQEELESVVGLDRRVEEGDLPRLPYLKAVVKETLRLHPPGPLLIPHESFNDCTVGGYFIPRKSRLIVNVWALARDPKSWEDADVFKPERFVGSPIDIKGQHFQMLPFGSGRRGCPGQPLALTVVEYTLASLLHCFDWKLPAGMKPGDLDMTEEFGLSTPRSVHLVAVPTLRLKV

SEQ ID NO: 309 - protein, 512 aa, Pinus radiata
MSVPEMGPFGVVVSGIVAIAIVYKLVQRWRFKLPPGPRPWPVVGNLLQIEPVRFRCFWDWSKKYGPIMSVWFGSTLNVVVSNTELAKEVLKEHDQQLADRPRSRSAEKFSRNGQDLIWADYGPHYVKVRKVCTLELFSPKRLEALRPIREDEVAAMVESIFNDCGKQEGIGKPLMVKKYLSGVAFNNITRLAFGKRFLNEEGKMDPQGVEFKEIVATGLKLGASLTMAEHIPYLRWMFPLEEGAFAKHGARRDNVTKAIMEEHTLARQTSGAKQHFVDALLTLQEKYDLSEDTIIGLLWDMITAGMDTTAITVEWAMAELVRNPRIQQKAQEEIDQVVGRDRVMNETDFPHLPYLQCITKEALRLHPPTPLMLPHKATQNVKIGGYDIPKGSNVHVNVWAIARDPAVWKDPVTFRPERFLEEDVDIKGHDYRLLPFGAGRRICPGAQLGINLVQSMLGHLLHHFVWAPPEGMKAEDIDLTENPGLVTFMAKPVQAIAIPRLPDHLYKRQPLN

SEQ ID NO: 310 - protein, 507 aa, Pinus radiata
MDIGWVSWYSVLGITSAIVFLVLDLWRRRTYGRLPPGPLGWPIVGNLLQLGNNPNESLFHLATKYGPLMSVSLGMKTTVVVSSPAMAKEVLKTHDQLLAGRTVIQSVKPASHDKYSFVWAQYGSHCRMLRRISNTELFNVKRLGTLQDLRRDQVLLTIQRILQEGIEGKSINIEDAMVHFSVNLLGNMAFGKDMFDSHSPAFEEFKNSISNMMTSLGAPNLADYFPFLQRLDPQGVGHNTKICMERVFRILDKFMEDRLVKRGKTMDGNDDAKDLLDVLLDMRSNEFTVIHIRSYLTDIFGAGIDTTAKTMEWAMAELIRNPEKMKRAQAELDQVVGRNRRVEESDTESLPYLCAVVKEVFRLHPVGPLLLPHRAVTACEIGGYLIPKDTQVIVNVWAIGRDPSIWNEPSKFVPERFMDSKMSSVDFKGQHFELLPFGSGRRMCVGLPLANRIIHLVLASLLHSFDWAPPKGMTAEHVDMTEKFGVVMQKAVPLETMPTPRLPPDLY

SEQ ID NO: 311 - protein, 514 aa, Pinus radiata
MEEISGFWYYVMIFMTLWLVLKVINMSRKGAGKLPPGPPGWPIVGNLLQLGGKPNESMYHLAAKYGPLMTLQLGMRTTVVASSPAMAKEVLKNHDQILSGRTVVEAAKCLSYSDTSLVWNNCGPRWRMLRKFCNIELFSVKRLEALQHLRRDQVFSTIRSIFEDSIKAKGVNLGHSAFLASLNLLGNLIFSQNIFGRDSQAAEEFKETVTKLMVIGGKPNLADYFPFLRILDPQGVSRDCSKNIAIVFELLDRSVEVRLQSRREGRTDDSSGKAKDFLDILLEYKSESGETFTKKDIIPFLYDMFVAGSETSSATIEWAMAEAIRNPRIMKKAQAELDEVIGTGRRVEETDIDRLPYLHAVVKETFRLHPPAPLLIPHRAESSCEVAGYMIPKDTQLLVNAWAIGRDPTIWDEPTKFKPERFVESEMEYRGQNFELIPFGAGRRICPGLPLAHRMVHVVTASLLHSFNWSLPDGITTDTMDMSERFGITLQRASPLIAIPSLRLPSHLFNDQHH

SEQ ID NO: 312 - protein, 511 aa, Pinus radiata
MIMMEMTSVANIEKGLLVIFAVIVGSIFISKLKSKKFKLPPGPLAVPIFGNWLQVGDDLNHKNLGDLAKKYGEIFLLKMGQRNLVVVSSPEVAKEVLHTQGVEFGSRTRNVVLDIFTGKGQDMVFTVYGEHWRKMRRIMTVPFFTNKVVQQYRFAWEDELGRAVDDIKKRPEASTTGIVIRRRLQLVMYNIMYRMMFDRRFQSEDDPLFLRLKALNGERSRLSQSFDFNYGDFIPVLRPFLRGYLKICKEVKEKRLSLFKDYFIDERKKLAASSRGSKVTGEKCGIDHIFEAEEKGEINEDNVLYIVENINVAAIETTLWSMEWGIAEIVNSPDIQQKIRAELDAVIGRAVPLTEPDITKLPYLQAVVKETMRLHMAIPLLVPHMNLDHAKLCGYDIPAESKILVNAWFLANNPEWWDKPEEFIPERFLGDQEKIEASGNDFRFLPFGVGRRSCPGIILALPIVALALGRLVQNFELLPPPGQSRVDVTEKRGQFSLQILNHSVVVAKPID

SEQ ID NO: 313 - protein, 506 aa, Pinus radiata
MEIMTVASLEKGLLAIFAVIVGAIFISKLKSKKLKLPPGPLAVPIFGNWLQVGDDLNHRNLGDLAKKYGEIFLLKMGQRNLVVVSSPELAKEVLHTQGVEFGSRTRNVVFDIFTGKGQDMVFTVYGEHWRKMRRIMTVPFFTNKVVQQYRFAWEDELGRAVDDIKKRPDASTTGIVIRRRLQLVMYNIMYRMMFDRRFESEDDPLFLRLKALNGERSRLAQSFDYNYGDFIPVLRPFLRGYLKICKEVKESRLSLFKDYFIDERKKLASTTGSKVTGDKCAIDHIFEAQDKGEINEDNVLYIVENINVAAIETTLWSMEWGLAEIVNHPEIQQKIRAELDAVIGRGVPLTEPDTTKLPYLQAVVKETLRLHMAIPLLVPHMNLHQAKLGGYDIPAESKILVNAWFLANNPEWWEKPEEFIPERFLGEEKIEASGNDFRFLPFGVGRRSCPGIILALPILALALGRLVQNFELLPPPGQSKVDVTEKGGQFSLHILNHSVVVAKPIA

SEQ ID NO: 314 - protein, 506 aa, Pinus radiata
MEIMTVASLEKGLLAIFAVIVGAIFISKLKSKKLKLPPGPLAVPIFGNWLQVGDDLNHRNLGDLAKKYGEIFLLKMGQRNLVVVSSPELAKEVLHTQGVEFGSRTRNVVFDIFTGKGQDMVFTVYGEHWRKMRRIMTVPFFTNKVVQQYRFAWEDELGRAVDDIKKRPEASTTGIVIRRRLRLVMYNIMYRMMFDRRFESEDDPLFLRLKALNGERSRLAQSFDYNYGDFIPVLRPFLRGYLKICKEVKESRLSLFKDYFIDERKKLASTTGSKVTGDKCAIDHIFEAQDKGEINEDNVLYIVENINVAAIETTLWSMEWGLAEIVNHPEIQQKIRAELDAVIGRGVPLTEPDTTKLPYLQAVVKETLRLHMAIPLLVPHMNLHQAKLGGYDIPAESKILVNAWFLANNPEWWEKPEEFIPERFLGEEKIEASGNDFRFLPFGVGRRSCPGIILALPILALALGRLVQNFELLPPPGQSKVDVTEKGGQFSLHILNHSVVVAKPIA

SEQ ID NO: 315 - protein, 514 aa, Pinus radiata
MGSEVLAQGSALLEKSLIALLVVVVGAVLVNKLRGRKLKLPPGPFALPIFGNWLQVGDDLNHRNLSDFAKKYGKIFLLKMGQRNLVVVSSPDLAKEVLHTQGVEFGSRTRNVVFDIFTGKGQDMVFTVYGDHWRKMRRIMTVPFFTNKVVQHYRFAWEDEISRVVADVKSRAESSTSGIVIRRRLQLMMYNIMYRMMFDRRFESEDDPLFLKLKALNGERSRLAQSFEYNYGDFIPILRPFLRGYLRICNEIKEKRLSLFKDYFVEERKKLNSTKTSTNTGELKCAMDHILDAQDKGEINEDNVLYIVENINVAAIETTLWSMEWGIAELVNHQDIQSKVRAELDAVLGPGVQITEPDTTRLPYLQAVVKETLRLRMAIPLLVPHMNLHDAKLGGYDIPAESKILVNAWWLANNPANWKNPEEFRPERFFEEEKHTEANGNDFKFLPFGVGRRSCPGIILALPLLALSIGRLVQNFHLLPPAGQSKVDVTEKGGQFSLHILNHSLIVAKPIASA

SEQ ID NO: 316 - protein, 520 aa, Pinus radiata
MMDITMSACVLACCGLLFFLVKVAKILWWKPLQIQKHFESQGISGPPCRLLYGNMLDMLKMREQAISRPMELSHDIIPRALSFYSRWTETYGNTFIHWFGSTARLNITDPDLIWEVLCNKSGLYKKSVQMKQLNGEGLLSLEGEMWAQHRRIINPAFHVEHLKGMVPMVIGSTSAMLDKWKERIESGENEIEVCKEFQNLTEDILAHTVFGSSYSEGKRVFALQAEQTMLITEVPRSLLRALISRFLPTKKNRYMRKLDREIRGSLRQLIQSKKQTWSLGKSSSYGGDLISVMTSSSRDQQQQGVVLQKGMMSIEEIVEECKTFFFAGHDTTLCLLAWAMILLAMHPQWQDRARKEILSICRHQAPKPENLNQLKIMTMILNESLRLYPPVVALIRQAEQDMKLGNFSVPAGTQLLFPIIALHHDPSLWGDNAKEFDPERFCDGVSKAAKHPMAFMPFGMGPRICVGQNFALLQSKLILAMILQRFSISLSPTYTHAPIPVVFLQPQFGAQIVMTPLSQE

SEQ ID NO: 317 - protein, 512 aa, Pinus radiata
MSEQLIGAAMEKLDLQRGLLALFALIVAAIFVSKLKSKKLKLPPGPRAVPIFGNWLQVGDDLNQINLTDLAKKYGDIFLLKMGQRNLLVVASPELAKEVLQTQGVEFGSRPRNVVYDIFTGSGQDMIFTYYGHHWRKMRRIMTAPFFTHNVVQKYRSAWEEEIGRAMEDIRARPEASSEGIVIRGRMQLMVYNIMYRMLFDRRFESEEDPLFLRLKTLNAQRSRMGQSFEYNYGDFIPILSPLLRGYMKICKQVKEKRQALFTESFIKERRQLGITKGDRKCGMDYIFEAQEKGEINEENVLYLIDNMNTAGMETIVWTMEWVIAELVNHPEIQQKIRDELDAVVGPGIPMTESDIVKLPYLQAVMKESLRLHITLPFVPRLNVPQTKLGGYDIPAGTKVLVNIWWLANNPELWDNPQDFIPERFLQEGEKIEFHGNDFRFLPFGAGRRSCPGIHMALANVALTVGRLLQNFELLPPPGKSKVDVSDKGGQFSLPILNHTLLVAKPRLPASS

SEQ ID NO: 318 - protein, 374 aa, Pinus radiata
MDCKGNTSTEDNSSVEKMEGDEWQGRLAMMELANMLSVPMALNAVAELNVADIIWQNGANTPLSASQILSQLQTQSPDSCSSAHNLQRIMRMMASYNVFKESVTEDSNGVRERLYSLTDVGKTLVKDETGLSYGSYVLQHHQKALMGAWPLLHSAVLDPSEEPFRKANGKPAYEFYGDDEDSNELMRTAMASLSMPFMRTVLKYYQGFKGVRTLVDVGGSSGLCLHMIIQKHGNIRGINFDLPYVVAGAPAYDGIEHVGGDMFEFIPSGDAIFMKWILSGWGDEKCIQILRNCYKALPDGGKVIACEPVLPKYTDDSQRTRTLLEGDIFIMTIYSSGGKERTEEEFRKLCSDAGFSKVETRDLDPFYSLLEIQK

SEQ ID NO: 319 - protein, 382 aa, Pinus radiata
MDSNMNGLAKSNGCEISRDGFFESEEEELQGQAEAWKCTFAFAESLAVKCVVLLGIPDMIAREGPRATLSLGEIVAKLPTESPDAACLFRIMRFLVAKGIFRASKSAREGGAFETRYGLTPASKWLVKGRELSMAPMLLMQNDETTLAPWHHFNECVLEGGVAFQKANGAEIWSYASDHPDFNNLFNNAMACNARIVMKAILSKYQGFHSLNSLVDVGGGTGTAVAEIVRAYPFIRGINYDLPHVVATASSLSGVQHVGGDMFETVPTGDAIFMKWIMHDWNDEDCIKILKNCRKAIPDTGKVIIVDVVLDADQGDNTDKKRKKAVDPIVGTVFDLVMVAHSSGGKERSEKEWKRILLEGGFSRYNIIEIPALQSVIEAFPR

SEQ ID NO: 320 - protein, 388 aa, Pinus radiata
MAADPMDSIDDVLALATVQHINSSRDPAATHQLQLYEMILSAVKPLALKAAVLLNIPDIIATRGNGGPLSVEQIAFHIAAANSSSTSNSHVDVGYLHRILRFLASYGVFTEEEEANQADGADLKKRKYGLTGISKLLAQGETQQSCGHFLHLIANNVYLDAFQHLHDSVLEGCYTFNKAYGMSPWEYLGRDPQANQIFNNAMAANSSTVMASVAKMYEDGFKSMATLVDVGGGIGTSLFIIVKEHSHIRGINLDLPHVIATAPLITGVEHMEGNKFEHIPSADAVMMKWILHDWADEECVKLLRRSYDATPAKGKVLIVEAVVEGDKEGESMSRRLGLLYDISMMVYTTGGKERTEEEFKGLFQRAGFKSHTIIKLPFLQSLIVLSKA

SEQ ID NO: 321 - protein, 388 aa, Pinus radiata
MAADPMDSIDDVLALATVQHINSSRDPAATHQLQLYEMILSAVKPLALKAAVLLNIPDIIATRGNGGPLSVEQIAFHIAAANSSSTSNSHVDVGYLHRILRFLASYGVFTEEEEANQADGADLKKRKYGLTGISKLLAQGETQQSCGHFLHLIANNVYLDAFQHLHDSVLEGCYTFNKAYGMSPWEYLGRDPQANQIFNNAMAANSSTVMASVAKMYEDGFKSMATLVDVGGCIGTSLFIIVKEHSHIRGINLDLPHVIATAPLITGVEHMEGNMFEHIPSADAVMMKWILHDWADEECVKLLRRSYDATPAKGKVLIVEAVVEGDKEGESMSRRLGLLYDISMMVYTTGGKERTEEEFKGLFQRAGFKSHTIIKLPFLQSLIVLSKS

SEQ ID NO: 322 - protein, 390 aa, Pinus radiata
MLTLVPPMDSIHHVLAPATGQHIDSSRESAATQELQLYEMIFSAVKPLALKAAVLLNIPDIIATRGNGGPVSAEQIAFHIAAANSSSTGNSHLDVGYLYRILRFLASYGVFAEQEEADQADDADTKKIKFGLTGISKLLVHAGNEQSCGPFLLLIASNVYLEAFQHLHESVLEGCYTFNKAHGMDPWEYLGNNPESNKIFNEAMATNTRSVMASVAKMYEDGFMSMATLVDVGGGMGSALSIIVKEHPHIRGINLDLPHVIATAPPITGVEHMEGNMFEHIPSADAVMMKWILHDWADEECVKLLRRSYDATPAKGKVLIVEAVVEGDKEGESMSRRLGLLYDILMMVYTTGGKERTEEEFKGLFQRAGFKSHTIIKLPFLQSLIVLSKA

SEQ ID NO: 323 - protein, 390 aa, Pinus radiata
MLTLAPPMDSIHHVLVPVTGQHIDSSPESAATQELQLYEMIFSAVKPLALKAAVLLNIPDIIATRGKEGPLSAEQIAFHIAAANSSSTSNSHVDVGYLYRILRFLASYGVFSEQEEADQADDADTKKIKFGLTGISKLLVQGGNQQSCGPFLLLIANNVYLEAFQHLHESVLEGCYTFNKAHGTSPWEYLGRNPQANQIFNEGVATNTRSVMASVAKMYEDGFKSMATLVDVGGGMGSALSIIVKEHSHIRGINLDQPHVIATAPPITGVEHMEGNMFEHIPSADAVMMKWIIHDWGDEECVKLLRRSYEATPAKGKVLIVEAIVGGDKEGESMSRRLGLSYDMLLMVYTTGGKERTEEEFKRLFQLAGFKSYTIIKLPFLQSLIVLSKA

SEQ ID NO: 324 - protein, 364 aa, Pinus radiata
MGSGFEKSEMKSKIVNEDEWLLGMELGNFSCLPMAMKAAVELDVLQIIANAGNGVQLSPTQIVGHIPTTNPDAAITLDRILRVLASHSVLSCSVTTNENGKAERFYGLTPLCKYLVNNQDGVSLAPLVLMNQDKVLMESWFYLKDAVLEGSQPFTKAHGMNAFEYPAIDQRFNKIFNRAMSENSTMLMNKILDTYEGFKEVQELVDVGGGIGSTLNLIVSRYPHISGINFDLSHVLADAPHYPAVKHVGGDMFDSVPSGQAIFMKWILHDWSDDHCRKLLKNCHKALPEKGKVIAVDTILPVAAETSPYARQGFHTDLLMLAYNPGGKERTEQEFQDLAKETGFAGGVEPVCCVNGMWVMEFHK

SEQ ID NO: 325 - protein, 361 aa, Pinus radiata
MNMPSVKDEEALRASALSLAFSLENPFLLKGAIRLKIPDIISKAGPDVSLSVHQIAAQLPSEDPDMGALSRILTYLSTMGILQAIVPPEGVNAPMNIKYGLTNLTKTHFTSEDISSRSLVPFVLLQTHPLYVTAWDHIDERVLHGGDNFKNSSGNGKDFWNFAAGDPELNVIFNAGMVSVTKASITDVLAVYDGFKDINTLVDVGGGRGEALSLIIEAHPHIRAINFDLPHVIATAPTLPGVQHMTGNLFESAPSADAIFMKNFLHSWNDEDCIKLLKNCHQALPDKGKLILSEAILDLTEGSDMIGSANVLDSLMLNCLPGGGERTRKQWNDLLQAAGFSISKIVGRNGTLTKVIEAIKS

SEQ ID NO: 326 - protein, 420 aa, Pinus radiata
MGESSPATHCATMGESSPATHCATMGESSPATHCATMGESSSLFSATSAAASAPDAALQIDTSSSPRLQLYDMIFSLVKPLALKAAVNLNIPDIIATHGGGEGSSLSVEDIASHIAASAPCNMNMKAPHLEYLFRLLRYLASYNVFTETSHAGGAAEFKRYRYGLTALSELLTVQNEYSCVPLVFSATSKVPWEGLQRLHETVMEGCPAFTKAFGMNAWDYFRTYPQENEIFNRALATDTRAVMASVVKVYDDGFKNINTVVDVAGGTGSAISMIVEAHPHIRGINLDLPHVIDTAPALPGVEHVRGNMFEHIPRADAVFLKCVLHNWKDEQCVEILKTCHEATPGNGKVIIVDAIIEEEVGCVQQMGLRSDIEMMAFTDGGRERTEDEFKKIFHLAGYRRYVITKLPSSPFSIIEIFKA

SEQ ID NO: 327 - protein, 385 aa, Pinus radiata
MKGMAMEAHEDVKLLECSGMDILEVNEEASLQASALRMAFSIANPFLLKCALSLKIPDIIWRAGPDSPLSVQQIASQLPSEAPDMDALSGILTCLSAMGILKAIKPTKDAQEINGAAEAMTMKYTLTDLTKTYFVSEDISPLSLAPLALMPTHALLMQPWDHIHERVLHVGDNFKNSSGHGKEFWSYVAAEPEVNNVFNAAMLSLTKVEMREILTYDGFKDVNTLVDLGGGHGQVMSQIISLYPHIHAINFDVPHVIATAPTLHGITHISGDMFESVPSGDAILMKHVLHLWDDEDCIKLLKMCYKATSDKGKLIIVDAVLDTTEDSDPIGSGQLMDIVMLTVFPGARERTREQWNGILQSAGFSLSKIVGKKGSLAKIIEALKC

SEQ ID NO: 328 - protein, 367 aa, Pinus radiata
MDRKEYNVQAPPPPPMDLIFSFAPALALKSAVLLKIPDIIATAGPDPDSSLSLRQIAARLPTQTPHLDYLSRILRYLSTLGIFIESQTSSDPLDFHYGLTHTAKCYFLSDHNENKPCSMVPLLLMQTHEKLMAPWHHFHECVLQGEGCEGAFTKAHGKDVWAYCMDDPDLNTVINNAMASFTNIVMIPFLSVYEGFKSGEKLTVVDVGGGKGPAIAQIVKAYPHINGINFDLPHVIATAPPISDVQHVGGDMFHSVPSGDVIFMKQILHDWDDERCAKILENCHRALPENGRLVVVEIVVSQDEQNRSQHVEMVASLTMLAHTNGRERNEQQWRRLFESSGFSTLKMVGLLGNTHFSVLEATKAKIH

SEQ ID NO: 329 - protein, 363 aa, Pinus radiata
  MOD_RES (7): variable residue
MVMGSSXSEEEELLGQAQAWRSTFAFAESLAVKSAVLLGIPDLIARQGPHGTLSLREIVARLPRETPDASCLFRIMRFLAAKGVFRASVDSDGGNESTRYGLTPASKWLVQESRELSMAPMLLMQNDERSVAPWHRFNECVLDGGVAFERANGAEVWDYASAHPEFNDLFNSAMACNARIVMKAILSKYQGFHGLNSLVDVGGGTGSAVAEIVRSYPSIKCINYDLPHVVATAPHHPGVEHQGGDMFKTVPLAEAILMKWIMHDWSDEECIKILKKCREAIPETGKVIIVDVVLDASDQDEKRKAVMDPTIGIAFDLVMVAHSSGGRERREEEWKKILLEGGFSRYNIITIPALQSVIEAFPR

SEQ ID NO: 330 - protein, 262 aa, Pinus radiata
MGFMRSVRIAFPQIMSRFWSFFALLCSKRARLPSQSPDGREAVLLNYVLKNSEKGNAESVLSAIESHAQQTWLMNLGKEKSSVLDGAVQKFDPKVVLELGTYCGYSAIRIASKMKKPDSKLVSIEKNPQNCSVARAIIEHAGLSSKVKVMEGTLGSNLEELDEILEEERVPYFEFIFMDNSNQCYLSDFLLLKDRGMLGKGTGIVANSSTEEFTGASDFFTYLRSHPEELETEEHKCSVDPLSLPSTVTVSIYKADLPIFIH

SEQ ID NO: 331 - protein, 259 aa, Pinus radiata
MASRAVQQTEVKAETTQTEEPTKVARHQEVGHKSLLQSDALYQYILETSVYPREPAPLKELREVTAKHPWNLMTTSADEGQFLGLLLKLINAKNTMEIGVYTGYSLLSTALALPDDGKILAMDINRENYDIGLPIIEKAGVAHKIDFREGPALPLLDEMLQKEEMHGSFDFVFVDADKDNYLNYHKRLIDLVKVGGVIAYDNTLWNGSVVAPPDAPLRKYVRYYRDFVVELNKALAADPRIEISQIPVGDGVTLCRRLH

SEQ ID NO: 332 - protein, 259 aa, Pinus radiata
MAGTSVAAAEVKAQTTQAEEPVKVVRHQEVGHKSLLQSDALYQYILETSVYPREPEPMKELREVTAKHPWNLMTTSADEGQFLGLLLKLINAKNTMEIGVYTGYSLLSTALALPDDGKILAMDINRENYDIGLPIIEKAGVAHKIDFREGPALPVLDELLKNEDMHGSFDFVFVDADKDNYLNYHKRLIDLVKVGGLIAYDNTLWNGSVVAPPDAPLRKYVRYYRDFVMELNKALAVDPRIEISQIPVGDGVTLCRRVY

SEQ ID NO: 333 - protein, 271 aa, Pinus radiata
MGSHAENGNGVEVVDPTDLTDIENGKPGYDKRTLPADWKFGVKLQNVMEESIYKYMLETFTRHREDEASKELWERTWNLTQRGEMMTLPDQVQFLRLMVKMSGAKKALEIGVFTGYSLLNIALALPSDGKVVAVDPGDDPKFGWPCFVKAGVADKVEIKKTTGLDYLDSLIQKGEKDCFDFAFVDADKVNYVNYHPRLMKLVRVGGVIIYDDTLWFGLVGGKDPHNLLKNDYMRTSLEGIKAINSMVANDPNLEVATVFMGYGVTVCYRTA

SEQ ID NO: 334 - protein, 249 aa, Pinus radiata
MAMAGLSTFFSFVRAQTNLKALIGTGQAGDGREKALLDHVLQTAERGNPQSVLQAIDSYSRRTSWLMNIGDDKGPFLDSALAKYSPRVALEIGTYCGYSAVRIASQMQRPRSMLLAVEMGPLNCQIATQIIDHAGVLSKVRVVEGKFDERLGTIKQFLEEMDAPFFEFVFLDHWKNRYMPDYLLLKEQGLIRKGSGIFADNMGPLIGPADFRKYVKTHPEELETQEFKSNTEYMRWMPDSVTVSTYMLD

SEQ ID NO: 335 - protein, 232 aa, Pinus radiata
MDHKSLLQSDALYQYILETSVYPREPEPLKELRELTSKHPRHVIAIPPGEGQFLGLLLKLMNAKNTIEIGVYTGYSLLSTALALPSDGKIIAMDINRANYDMGLPIIEKSGVAHKIDFREVPALPLLDEMLKNEEMHGSFDFAFVDADKDNYLNYHMRLIDLVKVGGLIVYDNTLWQGSVALPPEVAISEGMSYGEDREHMLELNRALAADPRIEIAQIPIADGVTLCRRLS

SEQ ID NO: 336 - protein, 232 aa, Pinus radiata
MEYKTLLQSDALYEYILETSVYPREPEPLKELRELTIKHPWHGMAIPPDEGQFLGLLLKLMNAKNTIEIGVYTGYSLLSTALALPSDGKIIAMDINRANYDMGLPIIEKAGVAHKIDFREVPALPLLDEMLKNEEMHGSFDFAFVDADKGNYLNYHMRLIALVKVGGLIAYDNTLWQGSVALPPEVAMSEGMNYGEDREHMLELNRALAADLRIEIAQIPIADGVTLCRRLS

SEQ ID NO: 337 - protein, 265 aa, Pinus radiata
MAQQCSGREEIPGTTDVQADSTQAQDEGNVAHYHTMGHKSLLQSDALYQYILETSVYPREPEPLKKLREVTAKVPGNVMAIPPDEAQFLGLLLKLMNAKNTIEIGVFTGHSLLSTAVALPDDGKIIAMDPDRATYEMGRPIIEKAGVAHKIDFKEGPALPFLDEMVKNVGMHGSFDFAFVDADKGNYLNYHERLIDLVKIGGVIAYDNTLWEGSVAAPPTDDMDEGFRNMRIFILEVNKVLAADPRIEIAQIPVADGITLCRRLS

SEQ ID NO: 338 - protein, 256 aa, Pinus radiata
MAGDLVSKLLSYFTFSNNTQAWLTGNSPDHREHALLSHVLQTAEKGNAESVLKAIVDFNSHTWLPILGEEKGFILDAAVKQFNPKVALELGTYCGYSAIRIASKMGKRGSKLVSIEMNSDNCAIARAIIEHAGLSSKVTVLKGTLKEVIGGIESEMNILNFEFIFMDHFKNCYLPDFLLLKDKHMLKKGAGIVADSIGFPEALDYLKYLKEHPQELKTEERKSDVKFLNWLQCKMTVSTYEVGEDDDIVQLIELVG

SEQ ID NO: 339 - protein, 295 aa, Pinus radiata
MTGLLCGGRNPNALSAICLHPASSAKPLPLNPPLISIWRYSKTKAVGVKLGCYGVSSRRHVSTDRKGVVISSDDKYGNKQVVSLTPQLYHYILANVREPQILRELREETSTMAGSQMQVSPDQAQLLAMLVQTLGAKWCIEVGVYTGYSSLAVALVLPESGRLVACERDENCLAVAKRYYQRAGVSHKVDVRHGFGIDTLQDLLQNGEANRYDFAFLDAEKRMYFDYYELLLQLIRPGGLIVIDNVLWHGRVADPLINDKKTISLRDFNKVVFNDERVNISMVPIGDGMTLCRKK

SEQ ID NO: 340 - protein, 361 aa, Pinus radiata
MTKYVIVSSIVCFFVFVSACIISVNGLVVHEDDLSKPVHGLSWTFYKDSCPDLEAIVKSVLEPALDEDITQAAGLLRLHFHDCFVQGCDGSVLLTGTKRNPSEQQAQPNLTLRARALQLIDEIKTAVEASCSGVVTCADILALAARESVAQAGGPKFPVPLGRRDSLKFASQSVVLANIPAPTLNLTQLMNIFGSKGFSLADLVALSGGHTIGIGHCNSFDNRLYNKATGKKIVDPSIANSLADDLYSLCPTVNNTVDFTNLDIQTPNAFDKKYYANVQKNQVLFTSDQSLYTETDSAEIVDSFASSQTVFFKKFVHGMHKMGQLDVLTGKKGEIRTTCSVPNPTSSAFEEVIEPVTHSEL

SEQ ID NO: 341 - protein, 250 aa, Pinus radiata
MYKRYPTVSEEYQKSVEKCKRKLRGLIAEKKCAPIMLRLAWHSAGTYDFKTKTGGPFGTIRHPDEIAHNANNGLDIAIRLLEPIKEQFPMISYADFYQLAGVVAVEITGGPDIPFHPGRPDKTEPPEEGRLPDATKGVDHLRDVFGHMGLSDKDIVALSGGHTLGRCHKERSGFEGAWTSNPLIFDNSYFKELLSGEKEGLLQLPSDKALLEDPIFRSYVEKYAADEDAFFADYAEAHLKLSELGFAEEE

SEQ ID NO: 342 - protein, 351 aa, Pinus radiata
MAKLMIFCLLCTLCIAYAIRDNVLTLNADPPLVNGLSWTFYQKSCPQLESIVKKRIDFYLKQDITQAAGLLRLHFHDCFVQGCDGSVLLDGSASGPSEQGASPNLSLRKKAFEIINDIKSRVDKACSVVVSCADVTALAAKESVRAAGGPQYRVPLGRRDSLKFATQNVTVANLPAPFFKVTALINAFASKNLNVTDLVALSGGHTIGMGHCTSFTDRLYPTQDTSLNKSFAQRLYTKCPSKTSTNTTVLDIRTPNVFDNKYYVDLMNREGLFTSDQDLYTDSRTKAIVKEFALNQDLFFQNFAVAMVKMSQLNVLTGSKGEIRHNCSASNLASTIEVAVEDVIESYASFM

SEQ ID NO: 343 - protein, 292 aa, Pinus radiata
MPMGPVVDAAYLKSIDKARRDLRALIAEKNCAPIMLRLAWHDAGTYDAKTKTGGANGSIRNEEELNHSANNGLKIALALCEPIKGKYPNITYADLYQLAGVVAVEVTGGPTIEFVPGRKDSLASPREGRLPDAKKGSQHLRDIFYRMGLSDKDIVALSGAHTLGKAHPERSGFDGAWTEQPLKFDNSYFVELLKGESEGLLQLPTDKCLVEDPSFRPYVDLYAKDEDAFFKDYAESHKKLSELGFRDPSSLPSGSGSEVSTSTVLAQGAVGVVVAAAVVIFGYLYEAKRKSK

SEQ ID NO: 344 - protein, 338 aa, Pinus radiata
MAGTSGLRLQFRPVLITGLALMLWIQAIHAQSSNGLTPNYYDKSCPEALSIIKSGIEDAVKQEARFAASLLRLHFHDCFVKGCDASILLDDTANFTGEKTAKPNLNSVRGFGVVDKIKSALEKKCPGVVSCADLLAVAARDSVVISGGPTWEALLGRRDSRSASKSGANYNIPAPTSTHQTLETKFKLKGLHSLDLVVLSGGHTIGLSRCTSFKARLYNNSGTAKPDPTLDTTYLKQLRIECPQNGTDDNQTVPLDPVTPFKFDVNYYKNIVASKGLLNSDEILYSTNGSKTAAYVKFYTTHTQAFFKQFAISMIKMGNLSPLTGSQGEIRKNCRKMN

SEQ ID NO: 345 - protein, 333 aa, Pinus radiata
MGSKKSARKPLELAGFVIWVLLGLCVSNGSAQLSENFYAKICPNVESIVRNVVSQKFTQTFVTVPGTLRLFFHDCFVEGCDASVIIQSTSNNTAEKDFSDNLSLAGDGFDTVIKAKQAVEKVCPNSVSCADILTMAARDVVALAGGPQFNVELGRRDGLISQASRVNGNLPKASFTLNQLNFLFARKGLSQTDMVALSGAHTLGFSHCNQFANRIYSFSASTPVDPSLNASYATQLQQMCPKNVDPTIAINIDPITPRKFDNVYYQNLQSGKGLFSSDEVLYTDLRTRNSVNKFAQSSDTFNTAFVSAMRNLGRVDVKTGFQGEIRQDCSRFN

SEQ ID NO: 346 - protein, 327 aa, Pinus radiata
MAFRYVSLNVIFLAFAFIQGTTAQLCPTFYQNTCPNVTNIVGQVIQQALQNDSRIAASLLRMHFHDCFVNGCDGSVLLDDTANFTGEKTAGPNNNSLRGFDVVDNIKAAVESACNATVSCADILAIAAERSVVLSSGPSWTIHLGRRDSTTANATLPNTAIPAPTDNVSTIIAKFQNVGLSVTDVVALSGGHTIGRARCTVFVNRLYNFSGTGNPDPTLNSSYLSTLQSTCPQNGNGSTLTSLDPCTPNTFDNNYYINLQNEMGLLQSDQELLNTTGAATISIVNDYTRSQADFFSNFSNSMINMGNINPLTGTSGEIRLNCRKVNG

SEQ ID NO: 347 - protein, 316 aa, Pinus radiata
MRSLVCISVMVFLCAINNAAHGQLSPTFYAKSCPTALSIVNAAVKKAVASEKRMGASLLRLHFHDCFVQGCDGSILLDDNSTFTGEKTAGANANSVRGFDVVDTIKTNLEAACSGVVSCADILAIAARDSVVALGGRSYTVQLGRRDSTTASLSSANSNLPSPASSLSTLMTAFQKQGLSTKDLVALSGAHTIGQARCTTFRTRIYNDTNINAAFATSAKANCPSTGGDNTLSPLDVLTPTTFDNKYYTNLKSQKGLFHSDQELFNGGSTDSRVSIYSTSQAIFFTDFAAAMVNMGNISPLTGTNGEIRTNCRKVN

SEQ ID NO: 348 - protein, 336 aa, Pinus radiata
MMIGIGKGSTALGFMVVVATLCELVPVNTQGTVVGFYKQTCPNVERLVQLRVQKKFSTDKTIVPALLRMHFHDCFVKGCDASLLVDSTAANQAEKEAGPNQTVRGFEFIDEIKKVMEAVCANTVSCADIIALATRDAVALAGGPRYDVPTGRRDGTVSKVDDANKLPDPNDSAIQSSSAFASKGLSVLDLVTLLGAHTVGITHCSFFNDRLYNFLGTGKPDPTMDPALVTKLKTTCPDPASGSSADPPINLDQGTPSVFDNSFYKQIAARRGILQIDQQLFEDASTTNFVRSFAGSSPKPLNFSQQFVQSIVKMGKLGVLTGNQGTIRKNCRVVNT

SEQ ID NO: 349 - protein, 341 aa, Pinus radiata
MARMKHIPGLTLQFQSVLITGAALFLWIQTSDAQDCNGLSHHYYQKSCPNAQAIIKSVVSDAVKKEARMAASLLRLHFHDCFVQGCDASILLDDTASFTGEKTALPNRNSVRGFEVVDKIKSKLEEACPGVVSCADILAVAARDSVGFSVGPYWEVLLGRRDSKTASKSGANNDIPAPNSTHQTLETKFNLKGLNVLDLVALSGSHTIGLARCTSFKARLYNQTVNGKPDPTLNTSYLKRLRAVCPQTGTDDNRTTPLDPVTPIKFDINYYRNLVEGTGLLRSDEILYSTKGSRTASLVRLYSTNTHAFFKQFAASMIKMGNISPLTGSSGEIRKNCRKRN

SEQ ID NO: 350 - protein, 318 aa, Pinus radiata
MTSFTAMASVVCIALLFFSTVAFAQLNSTYYDTSCPKLLATVKAAVKTAVANEKRMGASLLRLHFHDCFVNGCDGSVLLDDSSSLTGEKTALPNNNSLRGFDVIDTIKSQVEAVCSGIVSCADILAITARDSVVELGGPTWTVLLGRRDSATASLSAANTNIPAPTSNLSGLISSFQAQGLSTKDMIVLSGAHTIGQARCTVFRIHIYNESNINAAFATSLKTNCPSTGGDNNLSPLDLLTPTTFDNKYYTNLKSQKGLLHSDQQLFNGGSADSQVTTYSTTQSTFFTDFAASMLNMGNISPLTGTSGQIRKNCRKPN

SEQ ID NO: 351 - protein, 317 aa, Pinus radiata
MKTFLFIALCVLCISSINNVAHGQLTSTFYSKVCPTALSIVKAAVTKAVNNEKRMGASLLRLHFHDCFVNGCDGSILLDDNSTFTGEKTAGPNANSVRGFDVIDTIKTQVEAACSGVVSCADILAIAARDSVVQLGGPTWTVLLGRRDSTTASLSAANNNIPSPASNLSALISSFTAHGLSTKDLVALSGAHTIGQARCTTFRARVYNESNIDTSFATSVKANCPSAGGDNTLSPLDLATPTTFDNKYYPDLRSQKGLLHSDQQLFSGGSTNSQVTTYSSNQNTFFTDFTAAMVKMGNISPLTGTNGQIRKNCRKAN

SEQ ID NO: 352 - protein, 337 aa, Pinus radiata
MTMHSSSSNSNGSLWMVVMVLTVTAQLVLAQQQQLLSVDYYNSSCPQLESIIFKVMVRKQRANPTTAAGTLRIFFHDCFVEGCDASVLVSSMGAGHKAERDADINLSLPGDGFDAVARAKTAVEAQCPGVVSCADILTIATRDLITLVGGPKYQVKKGRKDGLVSEASRVAGNLPEATMSVDELNALFESKGFNQSEMTTLSGAHTVGFSHCKEFMGRIYKEPMDPTIDPQYAAGLQKVCPQQNLDPNMAAFNDVLSPRTFDNVFYQNLPKGLGLLASDQILYTDARTIGLVETYASDQNAFFRDFALAMDKLGSVGVKTGYEGEIRKSCDAFNKHS

SEQ ID NO: 353 - protein, 320 aa, Pinus radiata
MIMKTLLCTGVMAVFICFINTNAVNGQLRSTFYDKSCPRLQSIVKSVVKQAVAKEKRMGASLVRLHFHDCFVNGCDGSILLDDNATFTGEKTAGPNANSARGFDVIDSIKTQVEAACSGVVSCADILTIAARDSIVQLQGPRWPVMLGRRDSTTASLSAANNKIPSPASSLSSLISSFQGHGLSTKDLVALSGAHTIGQSRCAFFRTRIYNETNINAAFATSVKTNCPSVGGDNTLSPLDVVTPTTFDNKYHSNLKIQKGLLHSDQQLFNGGSTDSQVTSYSTNQNIFFRDFATAMVKMGNISPLTGTNGQIRKNCRKSN

SEQ ID NO: 354 - protein, 320 aa, Pinus radiata
MMMRTLVYIGVMAVFVSFININAVNGQLSSTFYDKSCPSLQSIVKSVVKQAVVKEKRMGASLVRLHFHDCFVNGCDGSILLDDNSTFTGEKTAGPNANSARGFEVIDSIKTQVETACSGVVSCADILTIAARDSIVELEGPTWTVMLGRRDSPTASLSAANNNIPSPASSLSTLISSFQAHGLSTKDLVALSGAHTIGQSRCAFFRTRIYNESNINAAFATSMKANCPSAGGDNTLSPLDVATPTTFDNKYYANLKIQKGLLHSDQQLFNGGSTDSQVTAYSTNQNSFFTDFAAAMVKMGNISPLTGTSGQIRKNCRKSN

SEQ ID NO: 355 - protein, 328 aa, Pinus radiata
MGTTRFGIIELGVVISIGLVLGSNLSEGNLQTGFYSSSCPTAESVVRSTVQQSVQADPTLAAGLLRLHYHDCFVQGCDGSILITGPNAEQTAPGHSGLRGFDVIENAKKQLERICPRVVSCADIVALAARDAVALSNGPNYDVPTGRRDGMRSFAGDASNMPDPTDSVDVLKRKFAAKGLSASDLVVLNGAHTIGTTACFFIEDRLYDFAGAGDADPSMNPGYLTELRSICPQGGDVNARVALDRGSEFQFDNEFLENVREGNGALQSDASMYQDSSTRGYIDSYFGLLGGLLGPSFESDFADAIVKMGQVDVKTGSNGKIRSVCSVL

SEQ ID NO: 356 - protein, 349 aa, Pinus radiata
MEAQYFSAMFLLVIVSSAGAYASDLPTPVEGLSWTFYNDSCPTLQSIVQSTLQPLLEQNITEAPGLLRLLFHDCFVQGCDASILLNGTASDPSEQQATPNLTLRAAAFEIINKIKEAVEAKCSGVVSCADILALTASYAVSMGGGPEFLVPLGRRDSLTFANQTVTLASLPSPTSNVTVLMTIFTEKGFNNFTELVALSGAHTFGISHCSSFVNRLYPTQDTTLNAAFARELEHTCPTNTTVNTTNLDIRTPNVFDIKYYIDLQNGEALLTSDEDLYNDTRTRQIVNGFALNQTSFFNQFALSMLKMVQLDVLTGAEGEIRKNCAVRNTNTSSYSIIDPAMGLSSSFSS

SEQ ID NO: 357 - protein, 318 aa, Pinus radiata
MASFTAMRSLAFIALLMCSTVAYAQLSATFYNTSCPKLLSTVQAAVKQAVANEKRMGASLLRLHFHDCFVNGCDGSVLLDDSSTLTGEKTAVPNNNSARGFDVIDTIKSQVEAVCSGVVSCADILAIAARDSVVQLGGPTWTVQLGRRDSRTASLSGANNNIPAPTSNLSALISLFQAQGLSTKDMVVLSGAHTIGQARCTSFRARIYNESNINAAYATSLKTNCPTTGSDNNLSPLDRVTPTTFDINYYSNLRSQKGLLHSDQQLYNGGSTVSMVTTYSNNKKTFFSEFPTSMINMGNINPLTGTSGEIRKNCRKPN

SEQ ID NO: 358 - protein, 322 aa, Pinus radiata
MALPSLRVIWVFVLLLILATVQAQLTANFYKESCPNLENLVIDVVAQAVRKEARMAASLLRLHFHDCFVNGCDGSILLDDTSSFQSEKNAGPNVNSARGFEVIDAIKSTVEKACPGVVSCADILTIVARDSVVLSAGPYWEVVLGRRDSTSASVDTANTDIPSPAFDVNRLVSTFQNQGLSPRDMVALSGAHTIGQARCVVFRNRIYNETTTIDGRYASVMHGRCPTSGGGDNNLSPLDFGSATRFDNRYFTNVEAKRGLLHSDQQLFSGGDTSIASLVHSYAANPPTFFNDFQRAMINMGNIKPLTGTNGQIRTNCRMVNS

SEQ ID NO: 359 - protein, 325 aa, Pinus radiata
MKTTGMARIMCAASFLIFACASTNAAGGLQLNFYDQTCPGVSNVVEEVVASYISRAPTLAAALLRMHFHDCFVRGCDGSVLLNSTKSSKAEKDAPPNLSLRGFQVIDAAKAAVEKLCPRVVSCADILALVARDAVHMLGGPFWNVPTGRRDGVVSIANEAVAKLPPPNGTFSKLKSIFASNGLDVKDLVVLSGGHTIGISHCNSFSGRLYNFTGKGDMDPSLDKNYAARLKIKCKLGDNKTIVEMDPGSFRTFDTNYFVNVKKNRGLFQSDAALLTDNEAQSYINQQLQYLSFFSDFAVSMEKMGRIRVLTGAVGQIRRHCAFAN

SEQ ID NO: 360 - protein, 336 aa, Pinus radiata
MASTAAMRIAITRVWCVVFFVTCVYGQLNPHFYDKTCPEALSIVNSTVVQAISEERRIGASLLRLHFHDCFVNGCDGSVLLDDTSSFTGEKTAVPNNNSARGFEVVDKIKKKLEQACSGVVSCADILAIAARDSVVTLGGPTWTVMLGRRDSRTASRSDANNNIPPPTSDLAKLISKFRAQGLSKREMVALSGAHTIGKARCVNFRGHIYNDSNIDKAYAKSLQDRCPKSGDDNKLSPLDYKTPTKFENNYYKNLVAEKGLLHSDQELFNGVSTDSLVTEYSKNLELFERDFTAAIIKMGNITPLTGSQGEIRENCRKRNSDSAIFLSSTHLIHNE

SEQ ID NO: 361 - protein, 727 aa, Pinus radiata
MVAGSDLGAVQANGNQNGNGFHHVHSVDLCIQNGPDPLNWGQAAKALQGSHFEEVKLMVESYFGSEEVSIEGKSLTIADVTAVARRPEAKVKLDAVSAKARVDESSNWVLQNMLKGTDTYGVTTGFGATSHRRTNQGAELQKELIRFLNSGVLTDGNVLPQETTRAAMLVRTNTLMQGYSGIRWEILETIQKLLNAGITPKLPLKGTITASGDLVPLSYIAGFITGRPNSRARCRDGKELGALEALQQIGVEKPFELQPKEGLAIVNGTSVGAALASIVCFDANIICIAAEVLSAMFCEVMLGKPEFTDPLTHRLKHHPAQMEAAAIMEYVLDGSSYMKNAAKKHEMNPLQKPKQDRYALRTSPQWLGPQIEVIRSATHMIQREINSVNDNPVIDVARDKALHGGNFQGTPIGVSMDNLRLALAAIGKLMFAQFSELVNDYYNGGLPSNLSGGPNPSLDYGFKGAEIAMASYTSELQYLASPVTTHVQSAEQHNQDVNSLGLISARKSAEAIDILNLMVSTYLLALCQAADLRHLEENMLSTVKSVVSHVAKKMLSTHNGELLTAGRFCEKDLLQAVENLHVFAYVDDPCNENYPLMQQLRQVLVAHALTETAQIQTQTQSSIFNKIPAFEKELKDQMEAEIGRARQDYYERGVAGSIPNRIQECRSFPLYDFARSQLGTQLLSGDRVTSPGEYIEKVYTGIREGKIISPLFKCLDGWSGTPGPFHS

SEQ ID NO: 362 - protein, 684 aa, Pinus radiata
MEYSHVKGKGCATAFTSHVKDIVLLINTFNEIKNINVDGSRITVAHVTALGRRPQVKVTLDNHGGNCRERVERCSFWVQEKAKEGADIYGVTTGFGACSSKRTNQLSELQEALIRCLLAGAFTCPSSSPGELSPITTRCAMFLRMNSFIYGCSGIRWEIMEALQQLINTQITPKCPLRGSVSASGDLIPLAYIAGLLIGNPQVKARIGGHGEEQEVAAPEALVKAGLQPFKLQAKEGLALVNGTSFATALAATVMYDANVLLLLVEMLCGMFCEVIFGREEFTHPLIHELKPHPGQIQSAALLEWLLRNSPFQELSREYYSINSLKKPKQDRYALRSSPQWLAPLVQTIREATATIETEINSANDNPIIDHVNGKALHGANFQGSAVGFYMDYARVALAGLGKLIFAQFTELMIEFYSNGLPGNLALGPDLSLDYGFKGVDIAMAAYSSELQFLANPVTTHVHSAEQHNQDINSLALISARKTEEALDILKLMLASYLSALCQAIDLRQLEQILVKAVSGVISSVSDACHLPESIKEGLINVARGIPVYTYLESPCDPSFPLVSALKQTFLDSILVFHDLQIVEQIQEFESHLKQRLEEELTATRLSYEQRNRIPMQEGSCFRTLIHGSKFFALYAFIRDELNTKMMTPRTDQTPQQDIQKVFDAIVDGRITVPLLQCLNGFIN

SEQ ID NO: 363 - protein, 832 aa, Pinus radiata
  MOD_RES (723): a, t, c, g, other or unknown
MHSLHPLPVTSFQILQSLGTRDFLVTSLLFINFSVGRDHVVICGRREQQNGEHKRINEVHGTVPTANVASAGAFDGKNPDHVTFPTHWKKAAEAMQCSHYEEVRKMIKQFNTTRKVVLRGTTLTVAEVTAVTRRVEVRVELDEASAKERVERSYQWVAKNVARGTDTYGVTTGFGATSHRRTDKAADLQKELIRFLNAGVVGKERLCLPAEYTKAAMLVRTNTLMQGYSGIRWEILDALRKLMDVNITPKLPLRGTITASGDLVPLSYIAGLLTARPNSKALSPDGHLLDAMEALRKAGILEPFKLQPKEGLALVNGTAVGSAVAASVCFDANVLGVLAEILSALFCEVMQGKPEFVDPLTHQLKHHPGQIEAAAVMEFLLDGSDYVKEAARLHEKDPLSKPKQDRYALRTSPQWLGPPIEVIRAATHSIEREINSVNDNPLIDVSRDMALHGGNFQGTPIGVSMDNMRISLAAVGKLLFAQFSELVCDYYNNGLPSNLSGGPNPSLDYGFKGAEIAMAAYTSELQYLANPVTTHVQSAEQHNQDVNSLGLISARKTAEAVEILKLMFATYLVALCQAIDLRHLEENMRSVVKHVVLQAGRKTLCTAEDGSLHDTGFCEKELLQVIDHQPVFSYIDDPTNPSYALMLQLREVLVDEALKSSCPDGNAESDHNLQPAESAGAAGILPNWVFSRIPIFQEELKARLEEEVPKARERFDNGDFPIXKQNKQVQDISHLQIREIRVGNRFANRAQVEKPGEDIEKVFEGICQGKIGDVILKCLDAWGGCAGPFTPRAYPASPAAFNASYWAWFDSTKSPSATSGRGFWSAQQQQVL

SEQ ID NO: 364 - protein, 711 aa, Pinus radiata
MAPQEFTGEVKFCAGNGGTASLNDPLNWAAAAESMKGSHFEEVKRMWEEFRSPVVRLQGSGLTIAQVAAVARRMGSVRVELETGAKAWVDESSNWVMDSMANGTDSYGVTTGFGATSHRRTRQGEALQKELIRFLNAGIFGGCGDSNSLPRDTTRAAMLVRANTLLQGYSGIRWGILEAMSGLLNAGITPRLPLRGTITASGDLVPLSYIAGLLTGRSNARAVTADGTELGAAEALAAAGVENGPFELRPKEGLALVNGTAVGSALAATVLFDANVVVLLSEVLSALFCEVMQGNPEFTDHLTHRLKHHPGQIEAAAIMEHLLDGSSYMKAAAAKHQEADALSKPKQDRYALRTAPQWLGPQVEVIRASTHMVQREINSVNDNPLIDAARNKALHGGNFQGTPVGVAMDNARLALAAVGKLMFAQMSELVNDFYNNGLPSNLSGGPDPSLDYGFKGAEIAMAAYTSELQFLANPVTTHVQSAEQHNQDVNSLGLISARMTAQAVDILKLMTSTYLVALCQAIDLRHLEENLLAAVRQSVGQACKKTLVVGPRGELLPSRFCEKDLLKAIDREPVFSYIDNPCSATSVLTTKLRQVLFEHAIEKTTNNDASILTRIPAFEEELKARIVAEVQETRGAFEKGAALVPNRIKDCRSYPLYEFVRVELGTSLLVGTNSRSPGEDFDKVFVAINEGKAVEPLFKCLERWNGAPIPI

SEQ ID NO: 365 - protein, 696 aa, Pinus radiata
MASQEFTGLMNLCAGNDRLNWASVAESMKGSHFEEVKRMVEEFRAPVVRLQGSGLTIAQVAAVARRLGSVRVELDTGARARVEESSNWVMDSMANGKAIYGVTTGFGASSHRRTSHAEALQKEMARFLNAGIFGGCGDSNTLPRDATRATMLVRTNTLLQGYSGIRWGILEAMTGLLNAGITPRLPLRGSITASGDLVPLSYIAGLLIGRPNARAVMADGTEVGAAEALAAAGVGNGPFVLRPKEGVALVNATAVGSALAATVLFDANVVVLLSEVLSALFCEVMQGDPGFTNHLIHRLKDHPGQIEAAAIMEHLLDGSSYMKAAATKNKEADPLSKPKKDRYALYTSPQWLGPQVEVIRASTHMVQREINSVNDNPIIDAAGNKALNGGNFQGTPVGVAMDNVRLALAAVGKLIFAQMSELVNDFYNKGLPSNLSGGPDPSLDYGFKGAEVAMASYTSELQFLANPVTTHVQSAEQHNQDVNSLGLISARMTAQAVEILKLMTSTYLVALCQAIDLRHLEENLHAAVRQAVGEACKKTLVVGPRGELLLLKAVDREPVFSYIDNPCSATSVLTTVLRQVLFEHALEKTTDNDGSILTRVPAFEEELKARIVADVHETRAACEKGTALVPNRIKDCRSYPLYEFVRVELGTSLLVGTDSRSPGEDFDKVFVAINEGKAVAPLFKCLEGWNGAPIPI

SEQ ID NO: 366 - protein, 686 aa, Pinus radiata
MEYSQLNSNSCITGRYRSCHVEDIILLIKTFNEINCINVDGSRITVAHVTALGRRPQVKVTLDNHGGNCRERVERCSLWVQEKAKGGADIYGVTTGFGACSSKRTNQLSELQEALIRCLQAGVFTGPSSSPGELSPITARCAMFLRMSSFIYGCSGIRWEIMEALQQLINSHITPKCPLRGSVSASGDLIPLAYIAGLLIGNPQVKARIGAHGEEQEVPAPEALMKAGLQPFKLQAKEGLALVNGTSFATALAATVMYDANVLLLLVEMLCGMFCEVIFGREEFAHPLIHEMKPHPGQRESAALLEWLLRDSPFQELSREYYSINSLKKPKQDRYALRSSPQWLAPLVQTIREATATIETEINSANDNPIIDPVNGKALHGANFQGSAVGFYMDYVRVALAGLGKLIFAQFTELMIEFYSNGLPGNLSLGPDLSLDYGFKGIDIAMAAYSSELQFLANPVTTHVHSAEQHNQDINSLALICARKTEEALDILKLMLASHLYALCQAIDLRQLEQILLNIVLGIISSVSDECHLQQSIKEQLISVARGIPVYTYLESPCNPSLPLVSALKQTFLDAIVTLHDIQIVEQITEFESHLKQRLEEEITAIVLSYEERTNSHMLEGSCCRTLIHGSKFFPLYAFIREELNAIMMTPRTDHTPQKGTQKVFDAIVDGRITAPLLECLNGFMN

SEQ ID NO: 367 - protein, 570 aa, Eucalyptus grandis
MISVAPSPETAPQNPSEVPQGEKREAPAACTIFRSKLPDIPIPNHLSLHSYCFEHVPQFPDRPCLISDSTGKSFSFSDALLLSRKVAAGLHNLGIRRGDVVMTLLQNCPEFAFSFMGASMIGAVTTTANPFYTPSEIFKQFAASRTKLVITQSLYVDKLRDHADGNGPTLGKDFVVVTVDDPPEGCVHFSVLGEANEEEAPEVAIHPDDPVALPFSSGTTGLPKGVILTHRNLITSIAQQVDGENPNLHLRAEDVMLCVLPLFHIYSLNSVLLCSLRAGAGVLLMHKFEIGTLLQLIERHRVSVAAVVPPLVLALAKNPLVEKFDLSSIRMVLSGAAPLGKELELALQTRLPGAILGQGYGMTEAGPVLSMCLGFAKQPFPTKSGSCGTVVRNAELKVIDPETGSSLGYNQPGEICIRGQQIMKGYLNDPEATSITIDADGWLHTGDIGYVDDDDEIFIVDRVKEIIKFKGFQVPPAELEALLVSHPSIADAAVVPQKDEVAGEVPVAFVVRSNGFELTEEAVKEFIAKQVVFYKKLHKVHFVHAIPKSPSGKILRKDLRAKLATAAPIS

SEQ ID NO: 368 - protein, 324 aa, Eucalyptus grandis
MSGAGKVVGVTGGSGYIASWLVKLLLHRGYTVRATIRDPTDPKKTGHLLALEGAKERLHLFKAELQQEGSFDSVVDGCECVFHIAFPYLPSAADPQAEIIDPAVKGTLNVLRSCAKASSIKRVVVTSSMATVAFSAKPVTSGIVIDETWDSDPEFCQKSKLWYILSKTFAEKAACEFAKENGIDLVIINPGHVFGPFLQPTVNFSVGLILNLINGAQTFPNTCYIFVDVRDVAHAHILAFENHSAHGRYCLVAKTVHCHDVLQILRNLYPTLHLPKKCEDEKPFSSKDEISTKKAEALGVDFTPLEVSLRDTVECLKEKGFISV

SEQ ID NO: 369 - protein, 324 aa, Eucalyptus grandis; identical to SEQ ID NO: 368

SEQ ID NO: 370 - protein, 308 aa, Eucalyptus grandis
MAPASLHEPPNAVCVMDASGRLGSRLVRRLLRRGYSVHAAVQSEGEIDRLKELSSSSPDDAERLKIFRSDPFDYQSIVDALRGCSGLFYAFEPPQDQPSYDEYMTEVEVRAAHNVLEACAQTDTIDKVVFTSSVTAVVWTDDRKSQESDFDERHWSNVNLCRKYKLWHALSKTLAEKAAWALAMDRGVNMVSVNGGLLMGPDLSIAHPYLKGAAEMYEDGVLVTVDVDFLVDAHLCVFEDVSSYGRYLCFNHIVNRPEDALKLAQMLTPSAPSMPQSYDQELKIIEQRIGNKKLNKLMVDFERGVQVD

SEQ ID NO: 371 - protein, 380 aa, Eucalyptus grandis
MPDKRPPSSPPPPPSPLQPPPLKRQHLPPPPPPEPLSPLAGNPTMPVDALPGSGQTVCVTGAGGFIASWIVKLLLERGYTVRGTVRNPDDPKNGHLRELEGASERLTLYKGDLMDYGSLEKAIMGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLKDLGLEFTPVKQCLYETVKSLQEKGHLPVPPPPEDSVRIQG

SEQ ID NO: 372 - protein, 380 aa, Eucalyptus grandis; identical to SEQ ID NO: 371

SEQ ID NO: 373 - protein, 380 aa, Eucalyptus grandis; identical to SEQ ID NO: 371

SEQ ID NO: 374 - protein, 327 aa, Eucalyptus grandis
MSAAGGAGKVVCVTGASGYIASWLVKLLLQRGYTVKASVRDPNDPKKTEHLLGLDGAKDRLQLFKANLLEEGSFDPIVEGCAGVFHTASPFYHDVKDPQAELLDPAVKGTLNVLKSCSKAPSLQRVVLTSSMAAVAYNRQPRTPEVVVDESWFSDPDLCRQTNAWYVLSKTLAEDAAWKFVKEKGIDMVTINPAMVIGPLLQPTLNTSAAAIGNLINAAPTFPNASFGWVNVKDVANAHILAFEVPSASGRYCLVERIAHYSEIVRILRELYPSAQLPEKSADDKPFVPIYQVSKEKVKSLGINYIPLEQNLKETVESLKEKGFVKF

SEQ ID NO: 375 - protein, 323 aa, Eucalyptus grandis
MSKQGEAVCVTGGSGCIGSWLVRLLLERGYTVHATVQNLEDEAETKHLEAMPGAASRLRLFCMDLLDYDSVLAAVRGCAGVFHLASPCIVDRVRDPEKELLDPAIKGTANVLTAAKEVGVRRVVVTSSISAITPSPSWPVDRVKAEDCWTDLDYCKQNGLWYPVSKTLAEKTAWDFAKEHGLDVVVVNPGTVMGPVIPPRLNASMLMLQRLLQGCTDTYQDFFMGSVHFKDVALAHILVYENESAKGRHLCVEAISHYGDFVAKVAELYPEYNLPRLPKDTQPGLLRTKNGAKKLMDLGLEFIPMEQIIKDSVESLKSKGFIS

SEQ ID NO: 376 - protein, 343 aa, Eucalyptus grandis
MTSKTAAPAEDMQPQPQPQPEPTKRGAVLVTGANGFIGSWLVRALLDSGYPAVRASVFPGSDASHLLALPGASPSRLLISEADVLDAAAVARAVDGCAGVFHVASPCSLEAPADPERDLLRPAVQGTLNVLEAARRAGVRRVVLTSSISALVPNPGWPPHKPFDESSWTDLDYCKPRQKWYPVSKTLAEKAAWEFAEKHGLDVVAIHPATCLGPLLQPGLNASSAVLLQLLQGSTDTQEYHWLGAVDVRDVARAQVLLYETPAASGRYLCTNGIYQFGDFAQRVAKLFPEFPIHRFTGETNPGLAACEDAAKRLIDLGFSFTPLEDAIREAVESLKARGYLRG

SEQ ID NO: 377 - protein, 319 aa, Eucalyptus grandis
MAERTLCVTGAGGFLASWVVKILLSKGYAVHGTVRDPSDAKYAHLKKLDKASEKLRLFKADLLDYDSLRLAIEGCCGVLHVACPVPSSSVSNPEVELLAPAVKGTLNVLKACSEAKVKRVVYVSSVAAMMMNPSWPKGQAMDELSWSDKEYCRRTENWYCLSKTEAESEALEYAKINGLDVISVCPSLIFGPVLQSTLNASTTALLNLMKGGQESVPNRLRNLVDVRDVAAAVILAYEKSEAEGRYTCTSHCIKTRDLVEKLKSLYPNYNYPHSFTETEEGITLSSEKLQGLGWTYKPLEETLVDSVESYRASGLLEVK

SEQ ID NO: 378 - protein, 518 aa, Eucalyptus grandis
MRSGACSALLLLLLLRLLLIHGLSLPLASSRTTVHRGQFPPSFLFGTATSSFQIEGAYLQGNKSLSNWDIFSHIPGKIEDGSNADVTDNHYNLFMEDIELMCDLGVDAYRFSISWSRVLPKGRFGEVNSEGIEFYNNLIDALLVKGIKPFVTLNHYDIPQLLEDRYGGWLSSEIQLDFGYFAQVCFEAFGDRVTYWTTFNEPNVFIYDGYVVGTYPPGRCSYPFGNCSYGDSALEPYIATHNLVLSHATAAQIYRKNYQEKQGGMIGIVISAAWYEPYSDTPADRLAVQRALAFDFAWFVDPFVYGDYPPEMRQIVGSRLPTFSAEERNKLDAKLDFIGINHYTTKYAKDCMFSPCTSPYSLGEAFVYVTGEKDGVYIGERTAMSDFFIVPRGIEGIVTYVKERYNNTPMFITENGYAQFAGPIDDSLNDTKRIEYHEGYLAVLSEVVRKGADVRGYFIWSLLDNFEWLHGYLVRFGLHYVDFQTLKRTPKWSATWCKEFLSEGNNTRPIRKTSTYEM

SEQ ID NO: 379 - protein, 512 aa, Eucalyptus grandis
MRIRVPSMLLLWSLLGLVARSTMAEETVIPETTRFDTGGLSRSAFPKGFVWGTATSAYQVEGMADKEGRGPSIWDVFVKIPGIVAGNATGEVSVDQYHRYKEDVDLMAKLNFDAYRFSISWSRIFPDGTGKVNWKGVAYYNRLIDYLLSKGITPYANLYHYDLPEALEKKYQGLLSPNVVKDFADYADFCFKTFGDRVKNWMTFNEPRVVAALGYDNGFFAPGRCSKAYGNCTAGNSGTEPYIVAHHLILSHAAAVQRYREKYQEKQKGRIGILLDFVWYEPLTRSKADNYAAQRARDFHVGWFIHPIVYGEYPRTMQNIVGDRLPKFTKEEVKMVKGSMDFVGINQYTAYYINDPNQPKAKVPGYQQDWNAGFAYAKLGVPIGPKAHSYWLYNVPWGLYKAVMYIKERYGNPPVILSENGMDDPGNVTLSQGLHDTTRINFYKGYLTQLKKAVDDGANLVGYFAWSLLDNFEWRLGYTSRFGIVYVDYTNLKRYPKMSAYWFKQLLTRKKN

SEQ ID NO: 380 - protein, 512 aa, Eucalyptus grandis; identical to SEQ ID NO: 379

SEQ ID NO: 381 - protein, 512 aa, Eucalyptus grandis
MRIRVPSMLLLWSLLGLVARSTMAEETVIPETTRFDTGGLSRSAFPKGFVWGTATSAYQVEGMADKEGRGPSIWDVFVKIPGIVAGNATGEVSVDQYHRYKEDVDLMAKLNFDAYRFSISWSRIFPDGTGKVNWKGVAYYNRLIDYLLSKGITPYANLYHYDLPEALEKKYQGLLSPNVVKDFADYADFCFKTFGDRVKNWMTFNEPRVVAALGYDNGFFAPGRCSKAYGNCTVGNSGTEPYIVAHHLILSHAAAVQRYREKYQEKQKGRIGILLDFVWYEPLTRSKADNYAAQRARDFHVGWFIHPIVYGEYPRTMQNIVGDRLPKFTKEEVKMVKGSMDFVGINQYTAYYINDPNQPKAKVPGYQQDWNAGFAYAKLGVPIGPKAHSYWLYNVPWGLYKAVMYIKERYGNPPVILSENGMDDPGNVTLSQGLHDTTRINFYKGYLTQLKKAVDDGANLVGYFAWSLLDNFEWRSGYTSRFGIVYVDYTNLKRYPKMSAYWFKQLLTRKKN

SEQ ID NO: 382 - protein, 519 aa, Eucalyptus grandis
MEVSQLKKAIFIIQIVLASLFTSSNSIMTSDGPSSLPVNFLFGTASSSYQFEGAYKSDGKGLNNWDVFAHEPGNIIDGSTGDIAVDHYHRYLEDIRLMESLGVNSYRFSISWARILPKGRFAEINMAGIHYYNRLINSLLQKGIQPFVTLTHFDIPQELEDRYGGWLSPKSQEDFGYFADICFRYFGDRVKYWVTFNEPNIQATLAYRWGEFPPARCSAPFGNCTLGDSEMEPFIVAHNMILSHATAVNIYRTNYQKEQGGIIGIVIHAAWFEPISNSLADELAAERAMSFFMSWFLDPIIFGKYPAEMIEILGSILPEFSRSDQEKLKKGLDFIGINHYTSYYVQDCILSICEPGKGITKTEGYYKQSSEKNGVPIGQPTDLEWLNVYPQGMEYMVTYVKERYNNTPMFITENGYGEKDDLKLKDEKPLEDLKRVEYMASHLSALLSAVRKGADVRGYFAWSLLDNFEWQFGYTERFGLHHVNFTTLKRTPKLSASWYKQFIAEHSIRTITDPDHPNL

SEQ ID NO: 383 - protein, 523 aa, Eucalyptus grandis
MEVSQLKKAIFIIQIVLASLFTSSNSIMTSDGPSSLPGNFLFGTASSSYQFEGAYKSDGKGLNNWDVFAHEPGNIIDGSTGDIAVDHYHRFLEDIRLMESLGVNSYRFSISWARILPKGRFAEINMAGIHYYNRLINSLLQKGIQPFVTLTHFDIPQELEDRYGGWLSPKSQEDFGYFADICFRYFGDRVKYWVTFNEPNIQATLAYRWGEFPPARCSAPFGNCTLGDSEMEPFIVAHNMILSHATAVNIYRTNYQKEQGGIIGIVIHAAWFEPISDSLADKLATERAVSFFMSWFLDPIIFGKYPAEMIEILGSILPEFSRSDQEKLKKGLDFIGINHYTSYYVQDCILSICEPGKGITKTEGYYKQSSEKNGVPIGQPTDLEWLNVYPQGMEYMVTYVKERYNNTPMFITENGYGEKDDLKLKDEKPLEDLKRVEYMASHLSALLSAVRKGADVRGYFAWSLLDNFEWQFGYTERFGLHHVNFTTLKRTPKLSASWYKQFIAEHSIRTITDPDHPNLQQIY

SEQ ID NO: 384 - protein, 514 aa, Eucalyptus grandis
MRSQPCSILLRLLLIHGLFLRLTSSRTTVHRGQFPPSFLFGTATSSFQIEGGYLQGNKSLSNWDVFSHMPGKIEDGSNADVADDHYNLFLEDIQLMHSLGVDAYRFSIAWSRVLPQGRFGEVNSEGIEFYNNIIDALLVRDIKPFVTLNHYDLPQLLEDRYGSWLSSEIQLDFGYFAQVCFEAFGDRVTYWSIFNEPNVLIYHGYLLGTYPPGRCSYPFGNCSYGDSALEPYIATHNLVLSHATAAEIYRKYYQEKQGGMIGIVISAPWFEPYDDTPADRLAVQRSLAFYIAWFVDPLVYGDYPPEMRQVLGSRLPTYSAEERKKLLEGKLDFIGVNHYTTLYVKDCMFSSCASPYSLGDAFVYLTGEKDGAYIGERTAMPLFFVVPRGMEGIVTYVKERYNNTPMFITENGYAQPAGAIKDSLNDTKRIEYHENYLAVLSEVVRKGADVRGYFIWSLLDNFEWLYGYLIRFGLHYVDFQTLKRTPKWSATWYTEFLSEDNKIRAIRKTSTYKM

SEQ ID NO: 385 - protein, 525 aa, Eucalyptus grandis
MTKKLGFLLRLLVVGLVIAETVHGAYEFSRYDFPPGFVFGAGTSAYQVEGAANEDGRTPSIMDTWAHSDSGITSGANGDIACDQYHKYKVDVQLMAEMGLDAYRFSISWSRLIPNGRGSVNPKGLQYYNNLINELISHGIEPHVTLHHFDLPQALEDEYGGWISRNIVRDFAEYADVCFKIFGDRVKYWTTFNEANIFSMAGYDLGFMPPSRCSSPFGFLNCTRGDSLLEPYLAAHNILLSHASATRLYWKKYQNIQKGYIGLNLLSFYSVPFTNKTEDVIAARRVTDFFMGWFVEPLVYGDYPEVMKNNAGSRLPSFTALESQRVKGSFDFFAVNFYSANYVKDNPESLNIEPRDYFTDMAVQWKYKQGNASSFMNRFPPSFEFPLTPWGLQGVLELFKQNYGNPPIFIYENGQRMQRNTSLEDWPRIQYLQEHISVLLDTVRNGSNAKGYFTWSLLDVFELLDGYRSGYGLYYVDLDDPELRRYPKLSAKWYSRFLKGGSITPDSSIELEGNWSSLSSAQAMR

SEQ ID NO: 386 - protein, 525 aa, Eucalyptus grandis; identical to SEQ ID NO: 385

SEQ ID NO: 387 - protein, 547 aa, Eucalyptus grandis
MELKKQHPHGYLYANTRGGASASWCISLLMITATFLGCSCGREDPGVAGVNGDDDKIINRTSFPSDFVFGVGSSAYQSEGAADQQGRGLSIWDTFTKLFPDKISDHSSGFIADEFYYQFQEDINLLKAMGWDFFRFSISWPRIAPHGKISKGVNEQGVAFYNNLIDSLLAEGIQPFVTLFHWDVPQALEDEYGGFLSINIVEDYIDYVNFCFQKFGDRVKHWVTLNEPNYFTLYGYAMGIYAPGRCSSYINNCTAGNSATEPYIVAHHLLLSHAAAVKLYRDNYQATQNGKIGMVIATYWMTPKYSTNVSRKAASRAFDFQFGWFAHPITYGDYPKSMRRYVGERLPKFTKAQSEALKGSRDYMGVNYYTARYVDESASPFTTLNLSYTTDCHCNMTAEKDGIPIGQPTAAEWLYIYPKGIRELMHYVKKNYLDPTIYVTENGMADANNKSLPLEDALTDRLRISYFQLHLSNLSKAIEEGVNVKGYFAWSFLDDFEWVEGYTTRYGLVFVDYGNELKRYMKHSACWFQSFLQKDNATVNYSLRSDA

SEQ ID NO: 388 - protein, 525 aa, Eucalyptus grandis
MMKKLGFLLQLVVVGLVIAETVSAADEFSRYDFPPGFVFGAGTSAYQVEGAANEDGRTPSIMDTWAHSDSVITGGANGDIACDQYHKYKEDVQLMAEMGLDAYRFSISWSRLIPNGRGSVNPKGLQYYNNLINELISHGIEPHVTLHHFDLPQALEDEYGGWISRNIVKDFVEYADACFKIFGDRVKYWTTFNEANIFSMAGYDLGFLPPNRCSSPFGYFNCTRGDSSLEPYMAAHNILMSHASATRLYRKKYQNIQKGYVGLNLLSFYSVPFTNKTEDVIAAQRSNEFFLGWFVEPLVYGDYPEVMKKNAGSRLPSFTALESQRVKGSFDFFAVNFYSSNYIKDDPESLSIEPRDYKADMAVEWKYTQGNAMSFMNRFLPSFEFPLTPWGLQGVLELFKQNYGNPPIFIHENGQRMQRNTTLEDWPRIHCLQEHISVLLDTVRNGSNVKGYFTWSLLDVFELLDGYQSGYGLYYVDLDDPELRRYPKLSAKWYSRFLKGGSITPDGGIELEGNRSSLSSAQAMR

SEQ ID NO: 389 - protein, 551 aa, Eucalyptus grandis
MELKKQHPHGYLYAITRGASASASASSCIGLLMITATFLGCSCGREDPGVAGVNGEDDKIINRTSFPSDFVFGVASSAYQIEGAAADQQGRGLSIWDTFTELFPDKISDHSSGFIADEFYYKFQEDINLLKAMGWDFFRFSISWPRIAPHGKISKEVNKQGVAFYNNLIDSLLAEGIQPFVTLFHWDVPQALEDEYGGFLSLNIVEDYIDYVNFCFQEFGDRVKHWVTVNEPNYFTILGYAMGINAPGRCSSYINNCTAGNSATEPYIVAHHLLLSHAAAVKLYRDNYQAAQKGKIGMVIATYWMTPKYSTNASRKAASRAFDFEFGWFAHPITYGDYPKSMRRYVGERLPKFTKTQSEALKGSRDYMGVNYYTARYVDESASPFTALNLSYTTDCQCNMTVEKDEIPIGQPTAEEWLYIYPKGIRELMHYVKKNYQDPTIYVTENGMADANNKSLPLEDALTDRLRISYFQLHLSNLSKAIEEGVNVKGYFAWSFLDDFEWAEGYTTRFGLVFVDYGNGLMRHMKHSAYWFQSFLQKDNATVNYSLRSDA

SEQ ID NO: 390 - protein, 354 aa, Eucalyptus grandis
MSSEGGKEDCLGWAARDPSGFLSPYKFTRRAVGSEDVSIKITHCGVCYADVAWTRNVQGHSKYPLVPGHEIVGIVKQVGSSVQRFKVGDHVGVGTYVNSCRECEYCNDRLEVQCEKAVLTFDGIDADGTVTKGGYSSHIVVHERYCFRIPENYPMDLAAPLLCAGITVYTPMIRHKMNQPGKSLGVIGLGGLGHMAVKFGKAFGLKVTVLSTSISKKEEALSLLGADHFVISSDVEQMKAIAKSLDFIIDTAAGDHPFDPYMSLLKTGGILALVGFPSEVKFSPASLNLNMRTVTGSVTGGTKDTQEMIDLCAAQKIYPNIEVIPIDYANEALERLIKRDVKYRFVIDIENSLK

SEQ ID NO: 391 - protein, 354 aa, Eucalyptus grandis; identical to SEQ ID NO: 390

SEQ ID NO: 392 - protein, 354 aa, Eucalyptus grandis
MSSEGGKEDCLGWAARDTSGFLSPYKFTRRAVGSEDISIKITHCGVCYADVAWTRNVQGHSKYPLVPGHEIVGIVKQVGSSVQRFKVGDHVGVGTYVNSCRECEYCNDRLEVQCEKRVLTFDGIDADGTVTKGGYSSHIVVHERYCFRIPENYPMDLAAPLLCAGITVYTPMIRHRMNQPGKSLGVIGLGGLGHMAVKFGKAFGLKVTVLSTSISKKEEALSLLGADHFVISSDVEQMKAIAKSLDFIIDTAAGDHPFDPYMSLLKTGGILALVGFPSEVKFSPASLNLNMRTVSGSVTGGTKDTQEMIDLCAAQKIYPNIEVIPIDYANEALERLIKRDVKYRFVIDIENSLK

SEQ ID NO: 393 - protein, 354 aa, Eucalyptus grandis
MSSEGGKEDCLGWAARDPSGFLSPYKFTRRAVGSEDVSIKITHCGVCYADVAWTRNVQGHSKYPLVPGHEIVGIVKQVGSSVQRFKVGDHVGVGTYVNSCRECEYCNDRLEVQCEKSVMTFDGIDADGTVTKGGYSSHIVVHERYCFRIPENYPMDLAAPLLCAGITVYTPMIRHKMNQPGKSLGVIGLGGLGHMAVKFGKAFGLKVTVLSTSISKKKEALSLLGANHFIISSDLEQMKAIAKSLDFIIDTAAGDHPFDPYRSLLKTGGILALVGVPSEVKFSPASLNLNMRTVTGSVTGGTKNTQEMIDLCAAQKIYPNIEVIPIDYANEALERLIKRDVKYRFVIDIENSLK

SEQ ID NO: 394 - protein, 356 aa, Eucalyptus grandis
MGSLEKERTTTGWAARDPSGVLSPYTYSLRNTGPEDLYIKVLSCGICHSDIHQIKNDLGMSHYPMVPGHEVVGEVLEVGSEVTKYRVGDRVGTGIVVGCCRSCGPCNSDQEQYCNKKIWNYNDVYTDGKPTQGGFAGEIVVGQRFVVKIPDGLESEQAAPLMCAGVTVYSPLVRFGLKQSGLRGGILGLGGVGHMGVKIAKAMGHHVTVISSSDKKRTEALEHLGADAYLVSSDENGMKEATDSLDYIFDTIPVVHPLEPYLALLKLDGKLILTGVINAPLQFISPMVMLGRKSITGSFIGSMKETEEMLEFCKEKGLTSQIEVIKMDYVNTALERLEKNDVRYRFVVDVVGSKLD

SEQ ID NO: 395 - protein, 356 aa, Eucalyptus grandis; identical to SEQ ID NO: 394

SEQ ID NO: 396 - protein, 356 aa, Eucalyptus grandis
MGSVDAERKTTGWAARDPSGTLAPYTYDLRSTGPEDAYIRVLYCGICHSDIHQIKNDLGMSRYPMVPGHEVVGEVLEVGSEVTGLRVGDRVGVGVLVGCCRNCTPCKSDIEQYCSKKIWSYNDVYTDGKPTQGGFAGEMVVAQKFLVKIPDGISSEQAAPLLCAGVTVYSPLNHFGLKQSGLRGGILGLGGVGHMGVKIAKAMGHHMTVISSSDRKREEALDHLGADAYLVSSDETGMKEAADSLDYIIDTVPVFHPLEPYLSLLKLDGKLILLGVINTPLQFLTPVVMGGRKAITGSFIGSMKETKEMLDFCEEKGITSQIEVIKMDYINAAFERLEKNDVRYRFVVDVAGSKLD

SEQ ID NO: 397 - protein, 353 aa, Eucalyptus grandis
MSSDGAKEDCLGWAARDPSGLLSPYKFSRRTVGSDDVSIRITHCGVCYADVGWTRNMTGHSKYPLVPGHEMVGIVKQVGSSVQRFKVGDHVGVGTYVNSCRECEYCNDGLEVHCEKMVLTFDGIDTDGTVTKGGYSSHIVVHERYCFRIPENYPMDLAAPLLCAGITVYTPMIRHKMNQPGKSLGVIGLGGLGHMAVKFGKAFGLKVTVFSTSISKKEEALSLLGADHFVISSDVEQMQAIAKSLDFIIDTASGNHPFDPYMSVLKTGGILALVGSSEVKFSPASLHHNMRTVSGSLTGGTKDTQEMIDLCAAQKIYPNIEVIPIDYANEALERLIKRDVKYRFVIDIENSLK

SEQ ID NO: 398 - protein, 339 aa, Eucalyptus grandis
MANTMKAARFLTQGGDLQIVDIEIPQPKAGEVRMKVHACGVCNSDKVVKMGILGNPYPRTPGHEAAGVVDAVGEGVSRFKKGDRVGLGWYAGHCGNCTPCEENVWSCCDRGQIAGVSIDGGYAEYAVARESAFARIPDDLSFEEAAPLMCAGVTVFNAMRNQDIRPGELVAIQGVGGLGHLAVQYASKMGFKVVAISSGADKEQFAKELGAAHYINVGPGVDAAAELTKLGGAKMIVATAPNAESINPLVKGLKIGGKLLVVGLPFEPLSISVFDLLQRNASVGSWSAGDSRDSEATMKFAAAKDVKAKIEIFPLSEAQKAYDRMMENKARFRCVLKIV

SEQ ID NO: 399 - protein, 359 aa, Eucalyptus grandis
MAKSPDQEHPCKAFGWAARDKSGLLSPLCFSRRENGDEDVTIKILFCGVCHSDLHVAKNEWGFTNYPVVPGHEMVGTVMKVGSDVKKFKVGERVGVGVIVGSCKKCESCQQDLENYCPQTIFTYNSHYTDGTKTYGGYSDMIVVDERYVLRFPDNLPLEGGAPLLCAGITVYSPMKYYGMTEPGKHLGVAGLGGLGHVAVKMGKAFGLKVTVISSSPKKETEAIERLGADSFLVTSDPAKMKAALGTMDYIIDTVSAVHPLLPLLSLLKLNGKLVTVGLPDKPLELPIFPLVLGRKLVGGSDIGGMKETQEMLDFCAKHGITADVEVIQMDYINTAMERLAKSDVRYRFVIDVASSLSQ

SEQ ID NO: 400 - protein, 380 aa, Eucalyptus grandis
MSSSQVITCKGVVCWGAGEEWKVEEIQVDPPKGSEVRMKMLFASVCHTDVLCSRGFPFPIYPRVLGHEGVGIVESVGEEVKELKKGDVVIPVFVGECGECENCNSEKTNLCLRHPLSFSGLLPDGTSRMSIRGQTLYHLLSCSTWSEYTVSDVNYVMKVDPDVALPHASFLSCGFSTGFGAAWMDSKVESGSSVAVIGLGAVGLGVVKGARVQGATTIIGVDKNGMKKDKGEAFGMTNFINPEAQQSSGNADSKSISEMVKDLTGGVGVDYCFECSGVPDLINQALEATKVGKGKAVVVGAGLDQFVQISFLNLLMGRTLKGTIFGGLKSKTHLPLLLHKCKNKEILLDELLTHEMKLEDVPKALDILKQSNCVKILIKI

SEQ ID NO: 401 - protein, 360 aa, Eucalyptus grandis
MAKSPEQEHPQAAFGWAARDPSGLLSPFKFSRRTTGEKDVKFKVFFCGICHSDLHSVRNEWGFSTYPLVPGHEIVGEVVEVGSKVEKFKAGDKVGVGCLVGSCGSCDSCHDQLENYCPKMILTYGAMYHDGTMTHGGYSNMMVVDEHFAIKFPQNMPLDAGAPLLCAGITVYSPMKFFGLDHPGIHLGLVGLGGLGHVAVKFAKAMGVKVTVISSSPGKREEALQRLGADAFLISSDTNQVQAAMGTMDGIIDTVSAVHPILPLIGLLKQNGKLVLVGAPDRPLELPVFPLIFGRKIVAGSCIGGIQETQEMIDFAAKHKITADIEVISIDYVNTAMDRLAKGDVKYRFVIDIGNTLKEA

SEQ ID NO: 402 - protein, 360 aa, Eucalyptus grandis
MAQETQNHTLSVSGWTAYDSSGEIKPYTFKRRENGVNDVTIKVLYCGICHTDLHYAKNDWGITMYPVVPGHEITGVVIKVGCNAGKFKIGDRVGLGCLAASCLKCEFCADSQENYCDQMQFTYNGIFRDGSITYGGYSNVIVADYRYVVRIPENLPMDSVAPLLCAGITVFSPLKDNGMLGSPGKKMGVVGLGGLGHVAVKFGKAFGHHVTVLSTSPSKETEAKGRLGADDFIVSTNSQQMQAGKRSLDFILDTVSAQHSLGPILELLKVDGTLVMVGAPDQPLELPSFPLIFGKRSVKGSMTGGMRDTQEMMDLCGKHNITCDVEVIAPDTINEAMDRLAKNDVRYRFVIDIAGRISNI

SEQ ID NO: 403 - protein, 360 aa, Eucalyptus grandis
MAQETQNHTLSVSGWAAYDSSGEIKPYTFKRRENGVNDVTIKVLYCGICHTDLHYAKNDWGITMYPVVPGHEITGVVIKVGCNAGKFKIGDRVGVGCLAASCLKCEFCADSQENYCDQMQFTYNGIFWDGSITYGGYSNVIVADYRYVVRIPENLPMDSVAPLLCAGITVFSPLKDNGMLGSPGKKMGVVGLGGLGHVAVKFGKAFGHHVTVLSTSPSKETEAKGRLGADDFIVSTNSQQMQAGKRSLDFILDTVSAQHSLGPILELLKVDGTLVMVGAPDQPLELPSFPLIFGKRSVKGSMTGGMRDTQEMMDLCGKHNITCDVEVIAPDTINEAMDRLAKNDVRYRFVIDIAGRISNI

SEQ ID NO: 404 - protein, 505 aa, Eucalyptus grandis
MGSDAESLVHVLLVSFPGQGHVNPLLRLGKRLASKGLLVTFTTPESIGKQMRKASNIGDEPAPVGDGFIRFEFFEDGWDEDEPRRQDLDQYLPQLEKVGKVLIPEMIRRNAERNRPISCLINNPFIPWVSDVAESLGLPSAMLWVQSCACFAAYYHYYHGLVPFPSESAMEIDVRLPCMPLLKHDEVPSFLYPTSPYPFLRRAILGQYKNLDKPFCILMDTFQELELEIIEYMSKICPIKTVGPLFKNPKVPNANVRGDFMKADDCVGWLDSKPAGSVVYVSFGSVVYLKQDQWDEIAYGLLNSNVNFLWVMKPPHKDSGYTVLTLPEGFLEKAGDKGKVVQWSPQEQVLAHPAVAAFVTHCGWNSSMEALASGMPVIAFPQWGDQVTDAKYLVDVFKVGVRMCRGEAEDKLITRDVVEKCLLEATVGEKAAEMKRNALKWKAAAEAAVAEGGSSDRNIQAFMDEVKRRSVEVALAKGSKSTVVEAPAAVREGAATNGKVELDSS

SEQ ID NO: 405 - protein, 499 aa, Eucalyptus grandis
MGSEALVHVLLVSFPGQGHVNPLLRLGKRLASKGLLVTFTTPESIGKAMRKASNIGEELSPVGDGFIRFEFFEDGWDEDEIRRQDLDQYLPQLEKVGKVLIPEMIRRNAEQGRPISCLINNPFIPWVSDVADSLGLPSAMLWVQSCACFTSYYYYYHGLVPFPSETAMEIDVQLPCMPLLKHDEVPSFLYPTTPYPFLRRAIMGQYKNLDKPFCILMDTFQELEHEIIEYMSKISPIKTVGPLFKNPKAPNATVKGDFMKADDCVGWLDSKPASSIVYVSFGSVVYLKQDQWDEIAYGLLNSGVNFLWVMKPPHKDSGYEVLKMPEGFLEKAGDRGKVVQWSPQEQVLAHPSVACFVTHCGWNSTMEALTSGMPVVAFPQWGDQVTDAKYLVDVFKVGVRMCRGEAENKLITRDVVEQCLREATSGPKAEEMKQNAMKWSAAAEAAVAEGGSSDRNIQAFVDEVKRRSLEVLAVSGKSTANGVAELGEPKVNGELKVVS

SEQ ID NO: 406 - protein, 499 aa, Eucalyptus grandis; identical to SEQ ID NO: 405

SEQ ID NO: 407 - protein, 499 aa, Eucalyptus grandis; identical to SEQ ID NO: 405

SEQ ID NO: 408 - protein, 499 aa, Eucalyptus grandis; identical to SEQ ID NO: 405

SEQ ID NO: 409 - protein, 499 aa, Eucalyptus grandis; identical to SEQ ID NO: 405

SEQ ID NO: 410 - protein, 497 aa, Eucalyptus grandis
MAQAEEKREENHVLLVAFSSQGHINPMLRLGKRLAARGIHVSLATTEIVRHRMLKSSGAGPADHVTGIELLFFSDGLSLDYDRKTNLDVYMDILGKQGPSNLSALIKEHYTSPKKLLCLVTNPFVPWVSDVAAEYNIPCAMLWIQPCALYAIYYRCFNKLSAFPTLTDPDMVVELPGLPSMEKEDLPSFVLPNNPFGSFPKLFSELFQGMEKFKWVLGNSFYELEKHVIDSMCELYPIRPIGPLVPPTLLGQDQELEDASVDMWKSDDTCIEWLTQQPPSSVIYVSFGSIVVLPAKQMEAIAMALKNVKRPFLWVVKPPEFPTPDGAGQLPSWFLEETKDQGQVVRWSPQTRVLSHPAVACFITHCGWNSMLETICSGIPLIAYPQWTDQPTNAKLIVDVFKIGVRIKKEADGNIRGEVIEKCIEEVMVGPVAEQLRKNAMALKAEAQKAVAAGGSSDENIRLFVEEITGDSCKKDGSPNVGNLSHEVQDKVSDKGV

SEQ ID NO: 411 - protein, 465 aa, Eucalyptus grandis
MAPPHFLLVTFPGQGHINPSLQFAKRLVRVGAHVTFATAIRARPRMAESESIPEGLSFASFSDGYDDGFDNWDEMEEYMDKIKRRGTETLSDLIASNLKSGRRFSGVLYTILLPWAAEVARSHGIPSTFVWIQPATVLDFYYYYFHGYGDLIRSTGGNPSVPIQLPGLPPLMACDIPSFFNSKNEYNFSLPLFQWHFKILLEEAKPRILANTFDALEPDAIRAINEFEVIGIGPLIPSAFLDGQDPSDTSFGGDLFKSSSGYMEWLDTKPKASVIYVSFGSISVLSKPQKEEMARALVEAGRPFLWVIRESGKEERDEDRLSFKEELDKIGMIVPWCSQVEVLSHPSVACFVTHCGWNSTSESLVCGVPMVAFPQWSDQQTNAKLVADVWRTGVRITPNEQGLVESGEMRRCLELVMGDGKEGEEMRRNARKFRDLAREAVKEGGSSDKNLRAFVDEVREASELE

SEQ ID NO: 412 - protein, 483 aa, Eucalyptus grandis
MDENRKRDWNRHLVLVPCPLQGHLNPMLSLASVFHSKGFGVTLVLVQTSSHPAATSWASDDFFYESLGGSDGSISNAPDVDLMRFLNEVNLKCKSSFRDCLMGLRMGRLRDRKLCVVYDAIMYFSAEVSDELEIPRMVLRTSIVANFLGLSMLSQKAYLPAQEDGAVKAIQELIPSMRARDMPVFDKSCPEATERVLAQIHESTSTASAIVWNTLQTLEQALLHRLQSSLSPPIFPIGPLHKYRTRDPRRRHHRSLFAVETGARREEDRIKCVSFLDSHPPGSVVYVSTGSLVKLSRSELAEMARGLADCGQPFLWAVELSSAHDGDIAQLIPRGEELLCAAADCHPNAPSMRGLVVAWAPQEEVLAHGSIGCFWTHNGWNSTLESMTEGVPMLCWPRVGDQKIIAGFVTRVWRVGLELECDGNGGLERGRISRSIKRLMAGEEGREIRKRALEMEETVELALSDGGCSSQSLSKLVDFIQLL

SEQ ID NO: 413 - protein, 601 aa, Eucalyptus grandis
MAPSPSTAFSIRLLAFALPFALLLGNAVLRAQASVHYYDFVLRETNITRNCTSWRLLLVNDSFPGPTIEVHKGDLVFVNVHNQGDYGVTLHWHGVKQPRNPWSDGPEYITQCPIPPGTNFTYEVNFTTEEGTLWWHAHSVWTRATVHGAIVILPEEGTTYPFPKPDGEEIIVLGSWYSEGDDLNSGVGVSLETGEAMPESIGYMINGEFGDFVACSQDSTYHMYVEYGKTYLLRIINAVVGAELFFAIADHNLTVVGMDASYTGPLVSPYLTTSPGSTLDVIFTANKTPGRYYMAVRRYTSQDTDVTDFNHMVATAILHYSGNYSLDTSPKFPNRSLPGYYDYSGADTFTFKLRGLASKEHPSDVPLNITRRMFITLSMNEILCPHHDCIVAPTTLGSSLNNQSWDDPSTDVLQAYYKNISGVYTADFPDFPPFAYNWTGADNPDAWGVANKVTRVKMLEYNESVEVVFQDSGVLQGAQRHPMHMHGYSFYVVGHGLGNFDNETDPLEYNLLDPPLVNTFSVPRDGWIAIRFVANNPGVWFWHCHIDKHMSWGMDTVFIVKDGGTEETSMRGPPSYMPPCEDSYNIARMKSRRLPRQISRI

SEQ ID NO: 414 - protein, 560 aa, Eucalyptus grandis
MGTFLGFVVTMTLLFCMAQGEVIYYDFVVKETPIQMLCGTNQTVLTVNGLFPGPEIHAHKGDTIYVNVTNTGPYGVTIHWHGVRQIRYPWSDGPEYITQCPIPTNSSFLQKIILTEEEGTLWWHAHSDWTRATIHGPIIILPVNGTNYPYKFDEQHTIVISEWYARDTKDIIDEALATGGDPDLSVAYTINGQPGDSYSCSNDSTYNLTAVQGKTYLLRIIHSGLNEEMFFGIADHNITVVGMDGAYLKPLNTEYLMITPGQTMDVLVTANQTPGRYYMVFSPFVDTNAPSNDNVTRGIFQYTGTYNQSETPVLPELPGLTNKSDAGNFTIQLRSLNSAEHPSTVPTNITRNITITVSVNQQPCPANQTCNGPDGSMHSASLNNISFSAPSISILQAYYNNLQGVYNKTFPDTPPFVFDYTGNVSALGEAANVTTEVLMINHNEEVEIRFQGTNLGAAENHPMHLHGYSFYVVGMGDGNFSDSYVSQYNTVDPPFVNTVGLPKNGWTAIRFKADNPGVWFMHCHLERHASWGMDTVIVVKDGPNDDQKVLPPPDDVPPCS

SEQ ID NO: 415 - protein, 562 aa, Eucalyptus grandis
MGTFLGFAVTATLLFCMAQGEVLFYDFVVNETPIEMLCETNRSVLIVNGLFPGPEIRAHKGDTIYVNVTNLGPYGITIHWHGVRQIRYPWSDGPEYVTQCPIPTNSSFLQKIKLTEEEGTLWWHAHSDWSRATIHGPIIILPVNDTNYPYKFDEQHTIVISEWYARDTKDIIDEALESGGDPDLSVAYTINGQPGDSYSCSNGSAYNITVVQGKTYLLRIIHSGLNEEMFFGIAEHNLTVVGMDGAYLKPLNIEYLMITPGQTMDVLVTANQILGRYYMVFSPFVDTSAPSNENVTRGIFQYNGTYNHSETPVLPELPGFTNKSDAGNFTIQLRSLNSEEHPSTVPTNITRNITITVSVNQQPCPANQTCTGPDGSMHSASLNNISFLAPSISILQAYYNNLLGVYNETFPDEPSFVFDYTGNVSALGEAAIVGKEVLMINYNEEVEIRFQGTNLGAAENHPMHLHGYSFYVVGMGDGNFSDSYVSDYNLVDPPYVNTVGLPKNGWTSIRFKADNPGVWFMHCHLERHASWGMNTVFIVGDGKEKHQKVYPPPSYMPPCTVS

SEQ ID NO: 416 - protein, 562 aa, Eucalyptus grandis; identical to SEQ ID NO: 415

SEQ ID NO: 417 - protein, 562 aa, Eucalyptus grandis
MESCWVRLLVLLFGVLVLPAMVECRVRHYKFNVVMKNMTRLCSTKPIVTVNGKLPGPTLYAREGDNVLVKVANHVKYNVTIHWHGVRQLRTGWADGPAYITQCPIQTGQNFIYNFTITGQRGTLLWHAHILWLRVTLHGAIVILPKRGVPYPFPKPSKEYVIILAEWWKADTETVINQAMSQGLAPNVSDAHTINGHPGPVPGCPSERSYTLPVESGKTYLLRIVNAALNEELFFKIAQHNLTVVEVDATYVKPFQTDTILITPGQTTNVLLTTNQNAGKYLITASTFMETAIVAIDNVTASAAVHYSGTLASASTVLTKPPPQNASAVANSFNNALRSLNSKKYPAKVPKTVDHNLFFTMGLGVNPCPTCTAGNGSRVVAAVNNISFVMPTIALLQAHVFNISGVFTTDFPGNPPTTYNYTATPPQNASVPTMNGTKVYRLPYNATVQLVLQDTGIIAPETHPIHLHGFNFFGVGKGVGNYDPKKDPKKFNLVDPVERNTIGIPSGGWIAIRFTADNPGVWFLHCHLEVHTTWGLKMAFLVDNGKGPKETLLPPPSDLPKC

SEQ ID NO: 418 - protein, 562 aa, Eucalyptus grandis; identical to SEQ ID NO: 417

SEQ ID NO: 419 - protein, 556 aa, Eucalyptus grandis
MDSWLQILVLVACITPAVVQGRVRNYTFNVVMKNTTRLCSSKPIVTVNGMFPGPTLYAREDDTVLVRVSNRVKYNVTIHWHGIRQLRSGWADGPAYITQCPIQPGQSYVYNFTITGQRGTLLWHAHILWLRATLHGAIVILPKRGVPYPFPKPHKEVVVVLGEWWKSDTEAVIKQAIKSGLAPNVSDAHTINGHPGPISNCPSQGGFTLPVESGKRYMLRIVNAALNEELFFKIAGHQLTIVEVDATYVKPFKTDTIVIAPGQTTNALISADQSSGKYLVAASPFMDSPITVDNMTATATLHYSGTLAATSTTLTKTPPQNATAVANNFINSLRSLNSKIYPAKVPLTVDHNLLFTVGLGINPCPSCKAGNGSRVVASMNNVTFVMPTTALLQAHFFNISGVFTSDFPGNPPTTFNYTGSPPTNLRTTSGTKVYRLRYNSTVQLVLQDTGIIAPENHPIHLHGFNFFAVGKGLGNYNPKVDQKNFNLVDPVERNTIGVPSGGWVAIRFRADNPGVWFMHCHLEIHTTWGLKMAFLVDNGKGPNESLLPPPSDLPKC

SEQ ID NO: 420 - protein, 556 aa, Eucalyptus grandis; identical to SEQ ID NO: 419

SEQ ID NO: 421 - protein, 556 aa, Eucalyptus grandis
MDSWLQILVLVACITPAVVQGRVRNYTFNVVMKNTTRLCSSKPIVTVNGMFPGPTLYAREDDTVLVRVSNRVKYNVTIHWHGIRQLRSGWADGPAYITQCPIQPGQSYVYNFTITGQRGTLLWHAHILWLRATLHGAIVILPKRGVPYPFPKPHKEVVVVLGEWWKSDTEAVIKQAIKSGLAPNVSDAHTINGHPGPISNCPSQGGFTLPVESGKRYMLRIVNAALNEELFFKIAGHQLTIVEVDATYVKPFKTDTIVIAPGQTTNALISADQSSGKYLVAASPFMDSPITVDNMTATATLHYSGTLAATSTTLTKTPPQNATAVANNFINSLRSLNSKIYPAKVPLTVDHNLLFTVGLGINPCPSCKAGNGSRVVASMNNVTFVMPTTALLQAHFFNISGVFTSDFPGNPPTTFNYTGSPPTNLRTTSGTKVYRLRYNSTVQLVLQDTGIIAPENHPIHLHGFNFFAVGKGLGNYNPKVDQKNFSLVDPVERNTIGVPSGGWVAIRFRADNPGVWFMHCHLEIHTTWGLKMAFLVDNGKGPNESLLPPPSDLPKC

SEQ ID NO: 422 - protein, 571 aa, Eucalyptus grandis
MRSLFLSALLLAVMSCFLPEVAHAGITRHYTFNIEMHSETRLCHTKRMITVNGKFPGPRIVAREGDRVIVKVVNHVSSNISIHWHGIRQLQGGWADGPSYITQCPIQTNQSYVYNFTITGQRGTLFWHAHISWLRATVYGPLIIFPKRGVPYPFAKPDKEVPMLFGEWFNADTEAIISQALQTGGGPNVSDAYTINGKPGPLYNCSSDTFKLKVTPGKTYLLRLINAALNDELFFRIANHSFTVVEADAVYVKPFKTDILVIAPGQTTNVLLKAKPNPHKSTYLMAARPYFTGQGTFDNTTMAGFLEYVQSSGNITLPKNLTLSLPTLPAINATSVVANFSQKFRHLNSRQYPAQVPQTVQKRFFFTVGLGNSPCSKNQTCQGPNGTKFAASVNNVSFALPSTALLQSYFFKKSNGVFTTDFPATPLRPFNYTGTPPNKTFVSNGTKVVVLPFNTSVELVMQGTSILGAESHPLHLHGFNFYVVGQGFGNFNQSTDPAKFNLVDPVERNTVGVPAAGWVAIRFLADNPGVWFMHCHFDVHLSWGLKMAWIVQDGKLPNQKLPPPPSDLPKC

SEQ ID NO: 423 - protein, 571 aa, Eucalyptus grandis
MSFQNQLFIFCTLLLGFLKLAEGKTRHYTFHIDSHNMTRLCHTRSVLSVNKQYPGPPLVAREGDNILVKVVNHVAANVTIHWHGVRQLRTGWADGPAYVTQCPIQTNQSYTYNFTLTGQRGTLLWHAHVSWLRSSIHGPIIILPKRNESYPFEKPSKEVPIIFGEWFNVDPEAVIAQALQSGGGPNVSDAYTINGLPGPLYNCSSKDTFKLKVKPGKTYLLRLINAALNDELFFSIANHTVTVVEVDAVYTKPFSAGCLHLTPGQTMNVLLKTKTDFPNSTFLMAAWPYFTGMGTFDNSTVAGILEYEHPKSSNYPPLKKLPQYKPTLPPMNSTGFVAKFTGQLRSLASAKFPANVPQKVDRKFFFTVGLGTSPCPKNTTCQGPNGTKFAASVNNISFVLPSVALLQAHFFGQSNGVYTTDFPTNPPVQFNYTGTPPNNTMVTNGTKTVVLAYNTSVELVMQDTSILGTESHALHLHGFNFFVVGQGSGNYNPNKDPTKFNLVDPIERNTFGVPSGGWVAIRFLADNPGVWFMHCHLDVHTSWGLKMAWIVLDGPQPNQKLPPPPSDLPKC

SEQ ID NO: 424 - protein, 575 aa, Eucalyptus grandis
MRTGGAGNKMALIAALLGFVFLEYGSLLCMARGNVHHYDFVLKETNFTRLCTTKSMLVVNESWPGPVIRVHKGDTVFVTVHNKGTYGVTVHWHGVKQPRNPWPDGPENITQCPIPAGTSFTQELSFSDEEGTLWWHAHSDWSRATVHGAIIIYPKPGTTYPYPMPYKEELLVLGEWYNGDVMAIIDEALETGGDPNVSDAFAINGQPGDLYDCSNASTYRLLVNYGKTYLLRIVNAVMNEEIFFGIAKHNLTVVGMDGAYLKPIKTDYIMITPGQTMDVLVTANQSPSHYYIMGSPFADTTAPFDNTSTTAIFQYSGNYTPPSTPYSPSLPAYDDKDAAGNFTVRLKSLASKQHPISVPLKITERIFMTVSVNQIYCANESCDGPDGNRLSASLNNISFVTPTIDILQAYYRHIHGVYNSTFPSIPPYFFNFTGDVGNNTIYPSQGTKVKMIKYGSVVEIIFQGTNVGAAENHPMHLHGYSFYVVGVGNGNFDNKTSPKTYNLVDPPLVNTIGLPKNGWTTIRFVADNPGVWFMHCHLERHASWGMDTVLIVTDGLANTNKMRGQPAYMPPCAKS

SEQ ID NO: 425 - protein, 591 aa, Eucalyptus grandis
MGSSPCELRWLLALLGGLLLVLPLAQGEDHYYTFVLRDTNFTRLCTTKSMFTVNESFPGPVMYVRKGDTAYVNVFNEGHYGVTIHWHGIKNPRNPWFDGPEYVTQCPIPPGTNFTYQVLFTSEEGTLWWHAHSDWTRATVHGAIVIKPALGTTYPFPEPDDEKVLVFASWYDEDVMELMEEALSEGGLTTLSDAYCINGQPGDFYNCSRENTTRISVDYGKTYLLRLINSVQNTDMYFGIANHSLTVVGWDGAYVKPFVMSYIMITPGQAMDILVTADQPLGEYYIILSPYFDGQADDFDMSIASAIFQYNGNYSYTGLPAYPSDFPGWEDIGPATDFVKQLRSLNSLEHPIDVPQDDEITTRMYITISISMMKCPNASCEGPDGNRLASALNNISFANPDLDVLQAYYSNITGYYTPDFPDLPPTLFNFTSEDLLTDNVTMSDQGTRVKVLNYNESVEIILQGTNVMNSGETHPMHLHGFRFYVIGMGQGNFDNKTAPETYNMYDPPEANTVPVPKDGWAVIRFRADNPGVWYMHCHFDRHMAWGMDTVFIVKNGTTAETSIREPPAYMPPCETDSSLLSALHSYLRQKA

SEQ ID NO: 426 - protein, 570 aa, Eucalyptus grandis
MEMRCSGGVQILQILGLVLVLGIPNCEAVLRHKFVIKETNYTRLCSTKSILTVNGQFPGPTLYAHKGDTVIVDVYNKANYNVTIHWHGVKQPRNPWHDGPEYITQCPIKPGGKFTQNVTFSLEEGTLWWHAHSDWTRATVHGAIIVYPKKSTSYAFAKPHTEVPIILGEWWKQDIVDIYDEFLQSGGDPNISDAYLINGQPGDLYPCSKQDTFKLVVEYGKSYLLRVINAALQDILFFAIAGHQVTVVGTDASYTKPLKVDYITISPGQTIDLLLEANQPKDHYYMAARVYSSATGVEFDNTTTTALIQYKGRYTPSSPPPLPYLPYYNDTAASVNFTGRLRSLASGEHPVPITVPQTVTHKFLFTVSVNTFPCVNDSCAGPNGSRLAASVNNISFVSPSISILQAYYYHIKGVFGTRFPSKPPLEFNYTADYLPLAVRTPRNGTEVKVLKYNATVEMVFQGTNVVAGTDHPMHLHGTSFYVVGWGFGNFDKKKDPKKYNLVDPPLQNTIAVPKNGWAAVRFQAFNPGVWFMHCHLERHLSWGMEMAFIVKDGPTSESQMLPPPPGMPPC

SEQ ID NO: 427 - protein, 593 aa, Eucalyptus grandis
MAVCATKLLVSAFVVVGLLLLLSASIVHGDVHYHDFVLKEKNYTRLCSTKSMLVVNDSFPGPTIYVKKGDTLYVNVHNQGAYGVTIHWHGVNQPRNPWFDGAEYVTQCSISPGTNFTYQVLFTEEEGSLWWHAHSEWARYSIHGFIVIHPADGTSYPFPQPDGEKEMVLASWYTEDVYASIAEKLAAGSDLLVSEAYTINGEPGDFCECSNETTHRWMVDYGKTYLLRLLNADMNAELFFAIADHNVTVVGSDAAYLKPFSSEIVFISPGQTIDVLVTANQPPGRYYIAARQYYSNQFKFSEYDHANATAILEYSGNYTAPSTPVFPSGLPSYTNYKAATGFVQSMRNIIDHVNVPMNITTRMYITVSLNKFTLEINDTTEESYPSASLNNISWYNPWTDVLQAYYRNISGFYTTDFPEFPPTFFNFTQHNLPLNTTNEPERGTKVKVLEYNEEVEIVFQNTDVANSSENHPMHLHGHSFYVLGTGFGNYNNETDPLTFNLIDPPYQNTASVPKDGWLAIRFRASNPGVWLWHCHLDKHLTWGMNSVFIVKNGGTEDTSIRDPPSYMPSCYPDSKLRLEEFSNSDEKLYSTSM

SEQ ID NO: 428 - protein, 562 aa, Eucalyptus grandis
MGTFLGFAVTATLLFCMAQGKVLFYDFVVNETPIEMLCETNRSVITVNGLFPGPEIRAHKGDTIYVNVTNLGPYGITIHWHGVRQIRYPWSDGPEYVTQCPIPTNSSFLQKIKLTEEEGTLWWHAHSDWSRATIHGPIIILPANDTNYPYEFDDQHTIVISEWYARDTKDIIDEALASGGDPDLSVAYTINGQPGDSYSCSNGSAYNITVVQGKTYLLRIIHSGLNEEMFFGIAEHNLTVVGMDGAYLKPLNTEYLMITPGQTMDVLVTANQALGRYYMVFSPFVDTTAPSNENVTRGIFQYNGTYNHSETPVLPELPGFTNKSDAGNFTIQLRSLNSEEHPSTVPANITRNITITVSVNQQPCPANQTCTGPDGSMHSASLNNISFSAPSISILQAYYNNLLGVYNETFPDEPPFMFDYTGNVSALGEAANVSTEVLMINYNEEVEIRFQGTNLGAAENHPMHLHGYSFYVVGMGDGNFSDSYVSDYNLVDPPYVNTVGLPKNGWTSIRFKADNPGVWFMHCHLERHASWGMDTVLIVGDGKLKHQKVYPPPSYMPPCTVS

SEQ ID NO: 429 - protein, 613 aa, Eucalyptus grandis
MGRDREKKKRTIIRNMANSTSPTSYIYFVAISLFLGNLVLGAQARTVHYYDFVLREINVTRNCTITTILVVNDSFPGPTIRVQKGDLVYVKVHNQGLYGVTLHWHGVKQPRNPWSDGPEYITQCAIPPGTNFTYEVNLTEEEGTIWWHAHNEWTRSTVHGAIVVLPREGSSFPFPTADGEHVIVLGSWYNEGTSLNKALEMEMSIGSPNIPRATGYLINGQYGDFVPCSNETTPHFFVDYGKTYLLRIVSAVVGTEMFFSIADHNMTVVGMDGAYTKPIVVSYLMIEPGQTMDILVTTNQSPGRYYMAAQRFATEYLAFTKFSHVVATAIIQYKGNYSLTSPPSFPIDTLPFYHDYSAAVSFTHQLRSLATEEYPVDVPYNVTTRMFITASLNSLPCPDDSCYMGDSKLAASLNNISWKDPSVDVLQAYYRNISGVYTADFPDFPPEMFNFTGDDLPSSLAEASVGTAVKVLNYNETVEIVFQGTNLLEGSEYHPMHMHGYSFYIVGLGSGNFNNETDPLAYNLVDPPKVNTFGVPRSGWVAIRFRADNPGVWFWHCHIDRHMSWGMDYVFIVKNGDTEETSMRPPPPYMPPCVASKKDKLFGEQDRNLKSDI

SEQ ID NO: 430 - protein, 500 aa, Eucalyptus grandis
MGVQLIVALICALVIPLLAVFFIDTKKKTRAFRNLPPGPRKLPIIGNLHQLGSLPHRSLARLSKQYGQIMLLHLGSIPTLVISSEDVAREVFKDHDTAFSGRPIFYAGKKLAYNQSDITFSTYGESWKELKKLVTQELLNNKRVKSFESVRKDEVKLMLDAITSSPGPVNIGELSLLLSNNIVCRVAFGSKYQADGSSVKSKFHETIRGIQKILGGFCVADLFPYMAWFNRLNGFNAKVEKNFMELDKFYDEVIEQHQDPQRPKLDHEDLVDVLLRLQRDPNQMNALTREQFKGVLTNIFNAGTGTSATTILWAMAELVRNPAVMRKAQEEVREVAKGKLHVEETDLLGLTYLRSVIKETLRLHPPLPLLVPRATIEDCKIRGYTVPRGTTVFVNVQAIATDPKSWENPEEFRPGRFLNSSIDFTGQNYEYLPFGSGRRGCPGRNFGVVIVELALANLLHRFDWKLPKGMSVEDIDMEEAYGLSTHKRTPLCLIATPMTG

SEQ ID NO: 431 - protein, 498 aa, Eucalyptus grandis
MDYLVLILCLHLLWGLIQVLSFVAARIKKAPSNLPPGPRPLPLIGNLLELGKLPHQSLARLARTYGPIMKLQLGFVTTVVISSPTLAKEILQTHDALFLNRTIPDTITAHNHDQFGLPWIPISPLFRNLRKMYNSHLLSNKKLDSNQYLRKKKVEELVCYVQKCAQNGDVIDIGEAAFTTSLNSLSNTVFSLDMTYPSNSAKELKEVVGQIMAEAGKPNLADYFPVLKKIDPQGLKQRMELYFGKMFDVFDVLIKKRWQQRMQSGSVASNDVLDALLDVMEEKSEDMDISLVKHLFLDFFVAGTETTSSTLEWAMAELLCNSEKLSKAQTELHEVIGKGNQMEEVDVPRLPYLQAIVKETFRLHPPFPLLLPRKSEADTQIGGFTIPKGAQVLINAWAIGRDPSIWVNPNEFVPERFLGSDIDLRGKNFELVPFGGGRRICPGLPLAARMLHLMLGSLINSFNWKLEDGVTPENMNMEDKFGISMQRAQPLKAVALPA

SEQ ID NO: 432 - protein, 500 aa, Eucalyptus grandis
MAWIWITLSFTLIAHLLLRALPWKRKSKKKLPPGPIGYPILGNLPLLGQNPHHDLHKLAQKYGPLMYLRLGFVHTIVVSSPELAEQFLKTHDLVFASRPPHEASKHISYEQRSLAFAPYGPYWRNIRKMCTLELLSNAKINSFKSMRREEVGLLVNFLKDAAHDHTAIDLSSKIFSLSADMSCRMVFGKKYMDKEFDERGFKAVIQEGMVLGATPNIGDYVPYLARFDLQGLTKRMKAVSKVFDAFFEKIIDEHMKSMKEEGESKDFVDVMLGFMGLNEGEYHIDRPHIKAIILDMLSGSMDTSATAIDWAMTELVRHPSAMKRVQDELEKAVGMNRAVEESDLEGLHYLDMVIKETMRLHPVAPLLLPHEATEDCTVNGFHIPLKSRVIVNVWSIGRDPKVWTTHDPEEFIPERFLGSSMDVKGRDFQLLPFGAGRRGCPGMQLGLTVVRFVLAQLVHCFDWDLPAGISPSELDMTEEFGLTAPRAKHLVVMPRYRLSE

SEQ ID NO: 433 - protein, 508 aa, Eucalyptus grandis
MALHILFTWLALSLPLLLLLLLSVKNFNNKKKNLPPGPPSLPIIGNFHQLGPMPHQSLWKLSRRYGPVMLIRLGGTPTIVISSPDAAREVLKTHDLDSCSRPQMVGTGRLSYDSLDVAFVEYGDYWRELRTLCVLELFSMKRVQSFRYIREEEVGSMIESIAKSAESGTPVNMSEKFMALTANFTCRVAFGKPFQGTELEDEGFMDMVHEGMAMLGSFSASDYFPRLGWIVDRFTGLHSRLEKSFRNLDDLYQKVIEEHRNANKSNEGKEDIVDVLLKMEKDQTELAGVRLKEDNIKAILMNIFLGGVDTGAVVMDWTMAELARNPRVMRKAREEIRSCVGNKKWVVEEDLSGLKYLKLVLKEVMRLHPPGVLLIPRETIGHFKLSGYDVDPKSCVYVNAWGMGRDPGLWERPEEFVPERFEDSPIDYKGNHFELIPFGAGRRRCPGMSMVMAMIELALANVLHSFDWELPEGMTEGDVNMEEGAGLAVFKKVPLTLLPIKASHKIDA

SEQ ID NO: 434 - protein, 508 aa, Eucalyptus grandis; identical to SEQ ID NO: 433

SEQ ID NO: 435 - protein, 508 aa, Eucalyptus grandis; identical to SEQ ID NO: 433

SEQ ID NO: 436 - protein, 508 aa, Eucalyptus grandis; identical to SEQ ID NO: 433

SEQ ID NO: 437 - protein, 524 aa, Eucalyptus grandis
MRDAMDSLLQALQNQPLPAAAAAATLVLVLLGLALLSRRRRLPYPPGPRGLPIIGNMLMLDQMTHRGLASLARKYGGLLHLRMGFLHMVAVSSPEHARQILQLQDHTFSNRPATIAISYLTYDRADMAFAHYGPFWRQMRKICVMRVFSRKRAESWRSVRDEVDKTVRAVAGSIGTVVNIGELVFALTRDITYRAAFGASATEGQDEFIGILQEFSKLFGAFNLADFIPYLGRIDPQGINERLVKARGSLDRFIDKIMDDHMEKKNKDKTLLSEEAETDMVDDLLAFYGEEEAKVNESEDLQNSIKLTRENIKAIIMDVMFGGTETVASAIEWAMAELMRSPEDLKKVQKELADVVGLHRRVEESDFEKLTYLKCVIKETLRLHPPIPLLLHETAEDAEVSGYFIPAKTRVMINAWAIGRDPTSWEDPDTFKPSRFLNEGAPDFKGSNFEFIPFGSGRRSCPGMQLGLYGLEFSVANLIHSFTWELPDGQKPGEMDMSDVFGLTAPRAERLMAIPSPRLLCPLY

SEQ ID NO: 438 - protein, 507 aa, Eucalyptus grandis
MTLLLSVVPLLLFLGLVARLRRKPPFPPGPRGLPVIGNMLMMGELTHRGLASLAKKYGGIFHLRMGFLHMVAVSSPDVARQVLQVHDGIFSNRPATIAISYLTYDRADMAFAHYGPFWRQMRKLCVMKLFSRKRAESWESVRDEVDTMVRTVAGSEGTAVNIGELVFELTRDIIYRAAFGTSSTEGQDEFISILQEFSKLFGAFNIADFIPYLSWIDPQGLTARLVKARQSLDGFIDHIIDDHMDKKRNKTSSGGGDQDVDTDMVDDLLAFYSDEAKVNESDDLQNSIRLTRDNIKAIIMDVMFGGTETVASAIEWAMAELMRSPEDLKKVQQELADVVGLDRRVEESDFEKLTYLKCCLKETLRLHPPIPLLLHETAEDAVISGYRIPARSRVMINAWAIGRDPGSWTEPDKFKPSRFLESGMPDYKGSNFEFIPFGSGRRSCPGMQLGLYALDMAVAHLLHCFTWELPDGMKPSEMDMGDVFGLTAPRSTRLVAVPTPRLVGALY

SEQ ID NO: 439 - protein, 514 aa, Eucalyptus grandis
MALLSLILATVAISAFLYSLLGYLSRPARPLPPGPRPWPLVGNLPHLGPVPHHSIAALARTYGPLMHLRLGFVDVVVAASASVAAEFLKTHDTNFSSRPPNSGAKHIAYNYQDPVFAPYGPRWRMLRKISSVHLFSGKALEDYRHVRQEEVAILTSALARAGSAPANLAQLLNVCTVNALGRVMLGRRMFGDGSGGGDAKADEFKSMVVEVMVLAGVFNIGDFVPALEWLDLQGVAAKMKRLHKRFDAFLGAIVEEHKASMGRGGNKHNDLLSTLISLQDVADEEGGKLTDTEIKALLLNMFTAGTDTSSSTTEWAIAELIRHPDILTRVQEEIDSVVGQDRLVTELDLPRLPYLQAVIKETFRLHPSTPLSLPRVAAESCEINGYHIPKGATLLVNVWAIARDPDTWAEPLAFRPERFLPGGEKPNVDVKGNDFEVIPFGAGRRICAGVSLGLRMVQFMTATLAHAFDWELANGALPEKLNMDEAYGLTLQRAEPLSVHPKPRLAAHAYKASS

SEQ ID NO: 440 - protein, 485 aa, Eucalyptus grandis
MDTDNKLFNVGVLLVATLVVAKLISALLIPRSGKRLPPVVRTWPVVGGLLRFLKGPMVMLREEYPKLGSVFTLNLLNKKITFFIGPEVSAHFFKASESDLSQQEVYQFNVPTFGPGVVFDVDYTIRQEQFRFFTEALRINKLKGYVNQMVMEAEDYFSKWGDSGEVDLKYELEHLTILTASRCLLGREVREKLFDDVSALFHDLDNGMLPISVIFPYLPIPAHHRRDKARKKLSEIFANIISSRKCAGKSEEDMLQCFIDSKYKNGRPTTEAEVTGLLIAALFAGQHTSSITSVWTGAYLLTNKKYLSAVSNEQKHLMEKHGNNVDHDVLSEMDVLYRSIKEALRLHPPLIMLLRSSHSDFSVKTRDGKEYDIPKGHIVATSPAFANRLPYIYQDPDQYDPDRFAVGREEDKVAGAFSYISFGGGRHGCLGEPFAYLQIKAIWTHLLRNFELELVSPFPEIDWNAMVVGVKGKVMVRYKRRQLSV

SEQ ID NO: 441 - protein, 485 aa, Eucalyptus grandis; identical to SEQ ID NO: 440

SEQ ID NO: 442 - protein, 505 aa, Eucalyptus grandis
MDLLLLEKTLLGLFAAAIVAIAVSKLRGKRFRLPPGPLPVPIFGNWLQVGDDLNHRNLTDLAKRFGDILLLRMGQRNLVVVSSPDLSKEVLHTQGVEFGSRTRNVVFDIFTGKGQDMVFTVYGEHWRKMRRIMTVPFFTNKVVQQYREGWEAEAAAVVEDVKKNPAAAREGIVLRRRLQMMMYNNMYRIMFDRRFDSEDDPLFVKLKALNGERSRLAQSFDYNYGDFIPILRPFLRGYLKICKEVKERRLQLFKDYFVDERKKLASVKRMDNEGLKCAMDHILEAQQKGEINEDNVLYIVENINVAAIETTLWSIEWGIAELVNHPQIQRKLREEIDAVLGPGVPVTEPELYKLPYLQAVIKETLRLRMAIPLLVPHMNLHDAKLGGYDIPAESKILVNAWWLANNPAHWKKPEEFRPERFLEEEAKVEANGNDFRYLPFGVGRRSCPGIILALPILGVTIGQLVQNFELLPPPGQSKLDTTEKGGQFSLHILKHSTIVLKPRSF

SEQ ID NO: 443 - protein, 505 aa, Eucalyptus grandis; identical to SEQ ID NO: 442

SEQ ID NO: 444 - protein, 536 aa, Eucalyptus grandis
MARLTSFVYATLLASTLIILANFLTSRLSIQLPFWSASLVVSLPLITCLFYLFFDRGANLPPGPLAIPIFGNWLQVGNDLNHRLLASMSKTYGPVFLLKLGVKKLVVVSDPELTTHVLHTQGVEFGSRPRNVVFDIFTGNGQDMVFTIYGDHWRKMRRIMTLPFFTNKVVNTYSDMWEQEMDLVVSDLTKDERVRSEGIVIRKRLQLMLYNIMYRMMFDSKFESMQDPLFIEATKFNSERSRLAQSFDYNYGDFIPMLRPLLKGYLNKCRDLQRRRLAFFNNYYVERRRKIMAANGDKHQISCAIDYIIDAQMKGEISEANVLYIVENINVAAIETTLWSMEWAIAELVNHPNVQRKIREEISAVLKGEPVTESNLHELPYLQATVKETLRLHTPIPLLVPHMNLEEAKLGGYTIPKESKVVVNAWWLANNPEWWKDAEDFRPERFLEEESGTDAVAGGKVDFRYLPFGVGRRSCPGIILALPILGLVVAKLVSNFEMKVPPGMDKLDTSEKGGQFSLHIANHSTVVFEPVAPREI

SEQ ID NO: 445 - protein, 358 aa, Eucalyptus grandis
MDPSETQSITTPAEDEELVAAFETCILTAVPMVFTSAVELGIIDLLAQEGGASARLSPSQIAVRLGITNPDAPRTINRMLRLLASFSYLSCTLHGDQSLYGLGPKSKYFVNSEAGSFTPLLRFLQHKTVINGWYGLQEAVKNGGSPFQNANGMSIFECAMKDPAFSTLLNNGMKAPTPLYMNKLLESYHGFEGAKTVADVGGGVGETLRLILDKFPNLRGINYDLPHVVKDAPTHPRMEHVGGDLSKSIPKADILFMKWLFHGRPDDFCKKLLKNCYDALPPNGKVVILDPILPDYPETDIVSRNTFTSDMIMLGASPGGVDRTRKELEALALSAGFDKPRILCRAYNMWVMELHKKK

SEQ ID NO: 446 - protein, 358 aa, Eucalyptus grandis; identical to SEQ ID NO: 445

SEQ ID NO: 447 - protein, 359 aa, Eucalyptus grandis
MSSKEAPVITTSHEDEEILNAFEVPSMAFVPMVLKGVHELGILELLAKGDQLSPLDIVARLSIDNPAAPDTIDRMLRLLASYSILSCTLVEDKEGRPQRLYGLGPRSKFFLDQNGASTLPTHMLLQEKTLLECWNCLKDAVKEGGADPFTRRHGMNVFDYMGQDPRFNDLYNKSMRTGSAIYMPKIAQHYRGFSKAKTVVNVGGGIGETLKTILSKNPHIRAINYDLPHVIATAPPIPGITHVGGDILKSVPKADVHFLKSVLHRGDDEFCVKVLKNCWEALPPTGKVVIVDEVAPEYPETDIVSQTTLLMDLNALRMTGGGKTRTQREFADLARASGFHAPKYVLRVYNLWLFELHKM

SEQ ID NO: 448 - protein, 377 aa, Eucalyptus grandis
MKAKRKDSRKKKFKKKNMSSKEAPVITTSHEDEEILNAFEVPSMAFVPMVLKGVHELGILELLAKGDQLSPLDIVARLSIDNPAAPDTIDRMLRLLASYSILSCTLVEDKEGRPQRLYGLGPRSKFFLDQNGASTLPTHMLLQEKTLLECWNCLKDAVKEGGADPFTRRHGMNVFDYMGQDPRFNDLYNKSMRTGSAIYMPKIAQHYRGFSKAKTVVNVGGGIGETLKTHTSKNPHIRAINYDLPHVIATAPPIPGITHVGGDILKSVPKADVHFLKSVLHRGDDEFCVKVLKNCWEALPPTGKVVIVEEVTPEYPGTDDVSQTTLLMDLNLLRTTPSGKARTQREFADLARASGFHAPKYVLRVYNLWLIELHKKM

SEQ ID NO: 449 - protein, 377 aa, Eucalyptus grandis; identical to SEQ ID NO: 448

SEQ ID NO: 450 - protein, 377 aa, Eucalyptus grandis; identical to SEQ ID NO: 448

SEQ ID NO: 451 - protein, 366 aa, Eucalyptus grandis
MGSTGSETQMTPTQVSDEEANLFAMQLASASVLPMVLKAAIELDLLEIMAKAGPGAFLSPGEVAAQLPTQNPEAPVMLDRIFRLLASYSVLTCTLRDLPDGKVERLYGLAPVCKFLVKNEDGVSIAALNLMNQDKILMESWYYLKDAVLEGGIPFNKAYGMTAFEYHGTDPRFNKIFNRGMSDHSTITMKKILETYKGFEGLETVVDVGGGTGAVLSMIVAKYPSMKGINFDLPHVIEDAPPLPGVKHVGGDMFVSVPKGDAIFMKWICHDWSDDHCAKFLKNCYDALPNNGKVIVAECVLPVYPDTSLATKNVIHIDCIMLAHNPGGKERTQKEFEALAKGAGFQGFQVMCCAFGTHVMEFLKTA

SEQ ID NO: 452 - protein, 366 aa, Eucalyptus grandis; identical to SEQ ID NO: 451

SEQ ID NO: 453 - protein, 364 aa, Eucalyptus grandis
MSACTNQAITTASEDEEFLFAMEMNALIALPLVLKATIELGILEILAECGPMAPLSPAQIASRLSAKNPEAPVTLDRILRFLASYSILSCTLAQDTEGNPLRLYGLGPKSKHFVRAHGTATFAAPLMLMLTDNIVTSSWYCLKEEIMEGGDNFKLANGLHVFEYTNKDRKFNEIFNNAMQAPTNMYMSKIVESYQGFNNVKTVVDVGGGMGASLRILLSKYPHIHGINFDLPHVIKEAPPYPGIEHVGGDMTNYIPKADVIIMKWIIHGADDKLCVKLLKNCWEALPEKGKVVIVDAVLPEHPETDIITRNAFLADMSVLNITPSGKDRTEREFEVLARASGFDAPKLVCRAYNMWVVELHKRM

SEQ ID NO: 454 - protein, 362 aa, Eucalyptus grandis
MSSAETLAVTTAQEDEEYLSAIKQNMISCVPLILKATIELGILKLLSESSAQLSPTQIASRLSIKNPDAGVAIDRILRLLASFSFLSCTLTQDKAGRPERIYSLGPLSKYYVNEEGASMAPWLLMLFDEVSLRSWFYLKDAVIEGEGDPFKLANGTTLFDYTGTDPRYNSYFNNAMKCMSTIFMGKFMDTYPGFENAKTVVDVGGGVGECLKLILSKHHHLRGINFDLPHVVKNGLSHPGLEHVGGSFVDDPIPKGDILLAKWQFHSFADDFVIQLLKRCWKALPASGKVVVIDPVSPEYPGTDLVTRATFTSDMVMLALPPGGKDRTMREVEVVAHATGFSSPKVGCQVLNMWALELYKIA

SEQ ID NO: 455 - protein, 362 aa, Eucalyptus grandis; identical to SEQ ID NO: 454

SEQ ID NO: 456 - protein, 366 aa, Eucalyptus grandis
MGSARSETQMTPTQVSDEGANLFAMQLVTASVLPRVLKTTIELDLLEIMARAGPGACLTPAEVASQLPTQNPDAPVMLDRIFQLLASYSVLTCTLRDLPEGKVERLYGLAPVCKFLMKNEDGISIAPLNLMNHSKLAVESWNCLKDAILDGGIPFNKAHGMTAFDYLGTDPRLNKTFNRLMSDLSTITMKKILETYNGFEGLKTVVDVGGGTGVVLNMIITKYPSIKGINFDLPHVIENAPSYHGVDHVGGDMFVSVPKGNAIIIKWICHNWSDEDCAKLLKNCYDALPVNGRVIVAEHILPVYPDPSLATKGVSHMDCLMLAYCPGGKERTEKEFEALAKGTGFQGFRVTCRAFNSYIMEFLKTA

SEQ ID NO: 457 - protein, 366 aa, Eucalyptus grandis
MDSAGSETQMTPTQVSDEEETLFAMQLATASVLPRVLKATIELDLLEIMARAGPGAYLTPGEVASQLPTQNPDAPVMLDRIFRLLASYSVLTCTVRDLPEGKVERLYGLAPVCKFLVKNEDGVSLAPLNLVNQDKLAVESWYYLKDAILEGGIPFNKAHGMTAFDYLGTDPRFNKIFNRAMFDFSTITMEKILEKYNGFEGLKTMVDVGGGTGAVLNMIIAKYPSIKGINFDLPHVIKDAPSYPGVEHVGGDMFVSVPKGDAIFMKSICHNWNNEHCTKLLKSCYDALPINGRVIVAEYILPVYPDPSLATKGVIHMDCMMLAHCPGGKERTEKEFEALAKGAGFQGFRVMCRAFNTCVMEFLKTA

SEQ ID NO: 458 - protein, 391 aa, Eucalyptus grandis
MFFIPPRAAPPKTEASCERERERERERERERMESLDDTEATLRGQAHIWKHMFAFVDSMALKCAVELRIPDIIHSYGGGPVTLVQIASRIPSPSPGTTYLARIMRLLVRKNIFSAHRRQPDGSQESHEMLYSLNPSSRWLLQGPGSENSLAPMVLMEDHQWLMSPWHCLGDCVRTGGVAFEIAHGRKIWDFASENPEFNHLFNDGMACTSKILVKAIVEGYKHGFESIGSLVDVGGGTGGAVAEIIKSYPHIQGINFDLPHVVATAPAHAGVTHVGGDMFETIPHADAVFMKWIMHDWGNEDCVKILKNCREAIPERNGKVIIAEVVLKPEGDGMFDEIGLVFDLLMIAHSSGGKERDELEWKKILEEGGFPRYNIIKTPSMLSIIEAYPL

SEQ ID NO: 459 - protein, 391 aa, Eucalyptus grandis; identical to SEQ ID NO: 458

SEQ ID NO: 460 - protein, 359 aa, Eucalyptus grandis
MDMVNGEMGSQQLLAQAHIWNHIFNFINSMCLKCAIQLGIPDTIHHHGQPMTLDALVSALQIHPSRAHCVDRLMRILVHSGFFEQKKLAPDGQGAYVLNRVSKLLLTDNPSNVAPFALSMLDPILINPWHGLSAWFHNHVEPTPFEMVRGMSFWRYAGQEPGFNRLFNDGMASDARLVASMVVNEHKGVFEGITSLVDVGGGTGTMAKAIANSFPHMECTIFDLPHVVANLEVSENVRCVPGDMFEAIPPADAIILKWILHDWSDEDAVKVLKRCREALGKGEGKKKKVIIIEMVMDNTKSDKEMVETQLFYDMLMMTLASGRERNEAEWAKLFVAAGFGDYKITPVLGLRSLIEVYPS

SEQ ID NO: 461 - protein, 359 aa, Eucalyptus grandis; identical to SEQ ID NO: 460

SEQ ID NO: 462 - protein, 412 aa, Eucalyptus grandis
MLTFDYKCPSPSAIPPRSVNHFLRRFLSTSRKRPSAHPNRCPTQKHRKRKMGSAQNQVQPCHEEEDPCLKALLYSSYHVFPVILHAAVELDLFGIIARAGPGAYVSPAEVVAHLPTQTLESPEIIDRVLRCLASHSLLTYKSETFDEGRTVERRYAISPVGKYYVKDEDGGSIGSLSLFAFHRATIDVWLQVKEAMVGGGNLFQKVHGKTIFQYMKEDSTLNMYFNNAMADLSATQTKKILEVYHGFDGISTLVDVGGGKGATLNMIVSKYPSIKGINFDLPQVIEHAPPYPGVQHVGGDMFASVPEGDAIMIKGTCHNWSDESCIKFLKNCYKALPANGKVIVMDFIMPDEPEETMASKYVSMLDNAMLIQPGGKERTEKQFEYLCKEAGFTGFKVAARAVSALGVIEFTK

SEQ ID NO: 463 - protein, 364 aa, Eucalyptus grandis
MANNQEREGRDQEDEVGKLAVRLAGAVVLPMTLKSALELGIIDALVSTGGFLSPTEIASRVGAKNPGAPVLVDRMMRLLASHGVIEWRLRRGDGNGDGGEREYGPGPMCRFFAKDQEGGDVGPLFLLIHDKVFMESWYHLNDVIMEGGVPFERAYGMTAFEYPAIDDRFNQVFNRAMASHTSLIMKKILDVYRGFEGIEVLVDVGGGVGFNLKMITSKNPHIKGINFDLPHVLADVPSYPGVEHVGGDMFESVPRGDAIFMKWILHDWSDEHCSKLLKNCFEALPANGKVILVEAILPAVPERNVSSINVFQQDLLMLAQNPGGKERTQKEYEVLAVQAGFTGCEVKCCAYNNWVVEFPKTAGH

SEQ ID NO: 464 - protein, 364 aa, Eucalyptus grandis; identical to SEQ ID NO: 463

SEQ ID NO: 465 - protein, 375 aa, Eucalyptus grandis
MDAANSGEMSESEIFRAYAHVWTHTFNFISSMSLKCAIELGIPDTLHRCGHPMTLPDLATALSVPASKAAFLGRLVAVLVHTGFLSCQKPAPRNNPISEDTADELGFEYSLTPASRVIVKGQPWDMSPIAMVMLNSLLVEPFHCLSEWLKSDSEVGPSSLRTPFDMKHGKGLWEYASQDEKLNRCLNEGMASDGPMMARLIMDKCGRRPFEGLRTAVDVAGGIGGLARELAKAFPEMEWTVLDLVHVVAGMEGTRNLKYVGGDMFEAIPPADAILLKWILHDWSDEESVKILKRCKEAITSNGKMGKVMIVEIVIGDELEEFHTTKLFYDMMLMGCLTGKERNEKEWAKLFREAGFSDYKLTPLAGFRSLIEVYP

SEQ ID NO: 466 - protein, 374 aa, Eucalyptus grandis
MQKHRERKMSSAQNQVKPCHEEEEEEDPCLKALLYSSSQVFPRILHAAVELDLFGIIARAGPGAYMSPPEVAAHLPAQTPESAEIIDRVLRCLASHSLLSCKSETLDSGRTVERRYAISPAGKYYVRDEDGSSVGSQALFAFHRATIDVWLQFKEAILGGGGNLFQKVHGKTIFQCMKEDSSLNKHFNDAMVGVSKMQTRKILEVYHGFDGIRTLVDVGGGKGATLNMIVSKYPSIKGINFDLAQVIEHAPSYPGVEHIGGDMFVSVPEGDAIMIKSTCQNWSDESCIKLLKNCYKALPANGKVIVMDFIMPDEPEDTMASRYVSLLDNAMLIMPGGKERTEKQFEYLCREAGFTGFKVAARAVSALGVIEFTK

SEQ ID NO: 467 - protein, 374 aa, Eucalyptus grandis; identical to SEQ ID NO: 466

SEQ ID NO: 468 - protein, 357 aa, Eucalyptus grandis
MDTSETQSITTPAEDEELVAAFETCILTAVPMVLRSAVELGIIDLLAREGGASAQLSPSQIAAHLGIANPDAPRTINRMLRLLASFSYLSCTLHGDQSLYGLGPKSKYFVSSEAGSFAPLLRFLQHKTLINSWYGLQEAVKNGGGLFENANGTNIFEYAGKDPALNTVFNNGMESPTPLYMNKILESYRGFEGAKTIADLGGGVGQNLRLILDKFPNLRGILYDLPHVIKDAPAHPRMERVGGDLLKSVPKADILFMKWLFHGLRDDFCKMLLQNCYEALPPNGKVVIVDPILPEYPETDIVSRNSFTSDMIMLYTSPGEDRTRKELEVLALSAGFDKPRIACRAYNMWVMELHKKK

SEQ ID NO: 469 - protein, 366 aa, Eucalyptus grandis
MSSAQNQVKPCHEEEEEEDPCLKALLYSSSQAFPRILHAAVELDLFGIIARAGPGAYMSPPEVAAHLPAQTPESAEIIDRVLRCLASHSLLSCKSETLDSGRTVERRYAISPAGKYYVRDEDGTSVGSQALFAFHRATIDVWLQFKEAILGGGGNLFQKVHGKTIFQCMKEDSSLNKHFNDAMVGVSKMQTRKILEVYHGFDGIRTLVDVGGGKGATLNMIVSKYPSIKGINFDLAQVIEHAPSYPGVEHIGGDMFVSVPEGDAIMIKSTCHNWSDESCIKLLKNCYKAVPANGKVIVMDFIMPDEPEETMASRYVSLLDNAMLIQPGGKERTEKQFEHLCREAGFTGFKVAARAVSALGVIEFTK

SEQ ID NO: 470 - protein, 366 aa, Eucalyptus grandis; identical to SEQ ID NO: 451

SEQ ID NO: 471 - protein, 364 aa, Eucalyptus grandis
MADNQEREGRDQEEEVWKLAAQLLGAVMLPMTLKSALELGIIDALISAGGFLSPAEIARRVGAKNPRAPVLVDRMMSLLASHSVIEWRLRRGDGDGDGGEREYGPGPVCRFFAKDEEGGAIGPLFLLTYDKVFMESWYHLNDVIMEGGVPFERAYGMTAFEYPAIDDRFNQVFNRAMVSHTSLIMKKILDVYRGFEGIEVLVDVGGGVGFNLNMITSKHPHIKGINFDLPHVLADAPSYPGVEHVGGDMFESVPRGDAIFMKWILHDWSDEHCLKLLKNCFEALPANGKVILVEAILPVVPERNVSSNIVFQQDLFMLAQNPGGKERTQKEYEALALQAGFSGCEVKCCAYDSWVVEFPKTAGH

SEQ ID NO: 472 - protein, 236 aa, Eucalyptus grandis
MEQGWDKGEILASKALSKYILETNAYPREHEQLKELREATVQKYQIRSIMNVPVDEGQLISMMLKLMNAKKTIEIGVFTGYSLLTTALALPADGKIIAIDRDKEAYEIGLPYIKKAGVDHKINFIQSDAFSVLNDLIVNSQEQGTFDFAFVDAKKDDYMKYHELMLKLVKVGGMIGYDDTLWFGAVALSETDDMGDHLKLWRDQLREFNSFLGKDPRVECCLLSVGGGLTLCRRLY

SEQ ID NO: 473 - protein, 236 aa, Eucalyptus grandis; identical to SEQ ID NO: 472

SEQ ID NO: 474 - protein, 246 aa, Eucalyptus grandis
MATAGEESQTQAGRHQEVGHKSLLQSDALYQYILETSVYPREPEPMKELRDITAKHPWNIMTTSADEGQFLNMLLKLINAKNTMEIGVFTGYSLLATALALPDDGKILAMDINRENYELGLPVIQKAGVADKIDFREGPALPILDQLIEDGKQGSFDFIFVDADKDNYLNYHKRLIELVKVGGLIGYDNTLWNGSVVAPPDAPLRKYVRYYRDFVLELNKALAADPRIEICMLPVGDGITLCRRIS

SEQ ID NO: 475 - protein, 247 aa, Eucalyptus grandis
MAANAEPQQTQPAKHSEVGHKSLLQSDALYQYILETSVYPREPEPMKELREITAKHPWNLMTTSADEGQFLNMLLKLINAKNTMEIGVYTGYSLLATALALPDDGKILAMDINRENFEIGLPVIQKAGLAHKIDFREGPALPLLDQLVQDEKNHGTYDFIFVDADKDNYINYHKRLIDLVKVGGLIGYDNTLWNGSVVAPADAPLRKYVRYYRDFVLELNKALAVDPRIEICMLPVGDGITLCRRVS

SEQ ID NO: 476 - protein, 247 aa, Eucalyptus grandis; identical to SEQ ID NO: 475

SEQ ID NO: 477 - protein, 247 aa, Eucalyptus grandis; identical to SEQ ID NO: 475

SEQ ID NO: 478 - protein, 247 aa, Eucalyptus grandis; identical to SEQ ID NO: 475

SEQ ID NO: 479 - protein, 238 aa, Eucalyptus grandis
MEEKTKVFSSSNKGLLQSKELYQYILDTSVYPREPELLRELREVTATHPRAGMGTAPDSGQLMAILLKLLNAKRTIEIGVFTGYSLLLTALNIPEDGKIIAIDEDRAAYEMGLPIIKKAGVEHKIDFIESKALQALDKIMQKPDSEGSFDFAFVDADKVNYWNYHERLLKLVKVGGLAVYDNTLWGGSVAMPEDAVGHMLKEGRKLTIEFNNLLAKDARVQICHASIGDGMTICKRIS

SEQ ID NO: 480 - protein, 320 aa, Eucalyptus grandis
MATHDMVGFSVVVVLLATSVITTARCKLSPSHYQSTCPKALSIVRAGVAKAIKNETRTGASLLRLHFHDCFVNGCDASILLDDTPSFVGEKTAAPNNNSVRGFEVIDRIKASLEKECPGVVSCADIVALAARDSVVHLGGPSWSVSLGRKDSITASRSLANTSIPPPTSNLSALITSFAAQGLSVKNMVALSGSHTIGLARCTSFRGRIYNDSNIDTSFAHKLQKICPKIGNDSVLQRLDIQTPTFFDNLYYHNLLQKKGLLHSDQELFNGSSVDSLVKKYACDTGKFFRDFAKAMIKMSEIRPPKGSNGQIRKNCRKVN

SEQ ID NO: 481 - protein, 320 aa, Eucalyptus grandis; identical to SEQ ID NO: 480

SEQ ID NO: 482 - protein, 250 aa, Eucalyptus grandis
MGKSYPTVSEEYKKAVEKCKKKLRGLIAEKSCAPLMLRIAWHSAGTFDVKTKTGGPFGTMKHAAELSHGANSGLDVAVRLLQPIKDQFPIITYADFYQLAGVVAVEVTGGPEVAFHPGREDKPQPPPEGRLPDATKGCDHLRQVFGVQMGLSDKDIVALSGGHTLGRCHKERSGFEGTWTANPLIFDNSYFKELLSGEKKELLQLPSDKALLADPVFRPLVEKYAADEDAFFEDYAEAHLKLSELGFADA

SEQ ID NO: 483 - protein, 250 aa, Eucalyptus grandis; identical to SEQ ID NO: 482

SEQ ID NO: 484 - protein, 350 aa, Eucalyptus grandis
MASRFSSFVLISCLVIASSPVHVSSSAHLVKGLSWSFYEKSCPKVESVIRKHLKKVFEKDIGQAAGLLRVHFHDCFVKGCDGSVLLDGSANEPSEQDAPPNRSLRRTAFKIIDDLSQLVEKKCGQVVSCADIAAIAARDSVFLSGGPEYDVPLGRRDGLTPATENVVIENIPAPTENASEILSALAKKNFDATDVVALSGGHTIGLAHCTAFENRLYPTQDPTMAKTFAHDLKGVCPTTNSTNTTVLDIRSPNRFDNKYFVDLMNRQGLFTSDQDLYEDPTTRDIVTSFAEDQELFFEKFVLAMTKMGQLSVLTGTKGEIRANCSVRNSENPDLLKFVVEEDLESYAELK

SEQ ID NO: 485 - protein, 350 aa, Eucalyptus grandis
MASRFSSFVLVSFLVIAASHVHVTSSAHLVKGLSWSFYEKSCPKVESVIKKHLKKVFEEDIGQAAGLLRLHFHDCFVKGCDASVLLDGSASGPSEQDAPPNRSLRPSAFKIIDDLRELVDKKCGRVVSCADIAAIAARDSVVLSGGPEYDVPLGRRDGLTFATQNVTLENLPAPTENASAILSALAKKNLDATDVVALSGGHTIGLGHCTSFENRLYPTQDPTMEKTFAHDLKGVCPTTNSTNTTVLDIRSPNRFDNKYFVDLVNRQGLFTSDQDLYEDPATRDIVTSFAEDQELFFEKFVLAMTKMGQFGLLTGTKGEIRANCSVRNSENPDLLKSVVEEDLESYAELK

SEQ ID NO: 486 - protein, 350 aa, Eucalyptus grandis; identical to SEQ ID NO: 485

SEQ ID NO: 487 - protein, 350 aa, Eucalyptus grandis; identical to SEQ ID NO: 485

SEQ ID NO: 488 - protein, 287 aa, Eucalyptus grandis
MALPVVDTEYLKEIDKARRHLRALIAYKNCAPIMLRLAWHDAGTYDARTKTGGPTGSIRNEEEYSHGANAGLKIALDFCEDVKSKCPRITYADLYQLAGVVAVEVTGGPTIDFVPGRKDSRVSPNEGRLPDANQGPPHLRDIFYRMGLSDKDIVALSGAHTLGRAHPERSGFDGPWTQEPLKFDNSYFVELLKGESEGLLKLPTDKALLEDPAFRPYVELYAKDADAFFRDYVISHKKLSELGFTPSSSGSKTVANGAVLAQGAVGVAVAAAVVILSYFYEVRKKMK

SEQ ID NO: 489 - protein, 333 aa, Eucalyptus grandis
MASKALIFLALLSFSAVSPRPAIAEINEEDKPGLVMNFYKDTCPQAEDIIKEQVKLLYKRHKNTAFSWLRNIFHDCAVQSCDASLLLDSTRRSLSEKETDRSFGLRNFRYLDTIKEAVERECPGVVSCADILVLSARDGIVALGGPHFPLKTGRRDGRKSRADVVEQYLPDHNESISVVLDRFAAMGINTPGVVALLGAHSVGRTHCVKLVHRLYPEVDPALNPDHIEHMLHKCPDAIPDPKAVQYCEDDRGTPMVLDNNYYRNILDNKGLLIVDHQLATDKRTKPYVKEDAKSQDYFFKEFARAITILSENNPLTGDQGEIRKQCNVANKHH

SEQ ID NO: 490 - protein, 333 aa, Eucalyptus grandis
MMVLSHAPSSLMGIAVFAALLFLLHPSSAQLSSNFYATSCPNVSNIVQTVIQQALQSDPRITASLLRLHFHDCFVDGCDGSLLLDNSANISSEKDAAPNTNSTRGFDVVDNIKSAIESSCPGTVSCADILALGAQASVVLSGGPSWTVLLGRRDSLTANQAGANTSIPSPFGSLANLTSQFAAVGLDTNDLVTLSGAHTFGRAQCRTFSPRLYNFTNGGPDPTISPSYLTTLQQLCPQNGNGSVPANLDPTTVNTFDNNYYANLQNNQGLLQSDQELFSTSGAATISIVNSFSGNQSAFFQSFAQSMINMGNISPLTGSSGEIRSNCRKVNGS

SEQ ID NO: 491 - protein, 333 aa, Eucalyptus grandis; identical to SEQ ID NO: 490

SEQ ID NO: 492 - protein, 322 aa, Eucalyptus grandis
MASPSSFSKAILTLACVVLLMGGTRAQLSTDFYAKTCPKLFPTVKKIVRAAIANETRMGASLLRLFFHDCFVNGCDGSNLLDDTPTFTGEKNAMPNQNSLRGFDVVDRIKSAVEKVCPSIVSCADLLAIIARDSVGILGGPMWDVKLGRRDARTASQAAANNSIPPPTNNLSALISSFQNQGLSLKDLVALYGGHTIGQARCTNFRARIYNESNLDSSFARVAKSNCPRVTGVGDNNLAGLDFQSATSFDNSYYINLIKKRGLLHSDQQLFNGGSTDSFIRTYAKSQSTFFKDFVASIIKMGDIKPLTGSNGEIRKKCRRVN

SEQ ID NO: 493 - protein, 316 aa, Eucalyptus grandis
MAIGVALFSSLLVLSFVSPISSLSSNYYDKTCPNAELIVANAVKNAAMKDKTVPAALLRMHFHDCFIRGCDASVLLNSKGSNKAEKDGPPNVSLHSFFVIDNAKKELEASCPGVVSCADILALAARDSVVLSGGPTWDVPKGRKDGRTSKASETTQLPAPLFNISQLQQSFSQRGLSMEDLVALSGGHTLGFSHCSSFAGRIRNFNTTHDIDPSMHPSLAASLRGVCPSKNRPKNAGTTMDPSSTTFDNTYYRLILQGKGLFSSDQALLAVPKTKDLVEKFAGSHKEFTDAFVKSMIKMSSITGGGEVRKDCRVVN

SEQ ID NO: 494 - protein, 316 aa, Eucalyptus grandis; identical to SEQ ID NO: 493

SEQ ID NO: 495 - protein, 339 aa, Eucalyptus grandis
MSPPPSPPPRCPALLRIAPLLLAVLLASSAAPAASRLTADYYAKSCPRFHQIVQDTVTSKQISTPTTAAATLRVLFHDCFGTGCDGSILLSAAPLAPPPERDADINLSLPGDAFDLVVRAKTALELACPGTVSCSDILVVAARDLVTMLGGPYYDVFLGRRDTRISRASLVAGLLPRPNMTMSELLSLFGARGFSAQEMVALAGAHTVGFSHCKEFSSGIYGFSKSSSYDPTYNPRFAQGLQKACASYGKDPTLSVFNDVMTPNKFDNMYYQNLPKGLGLLASDRGLYGDPRTRPFVEMYARDQDRFFKDFARAMQKLSLYGVQTGRRGEIRRRCDAIN

SEQ ID NO: 496 - protein, 319 aa, Eucalyptus grandis
MAWESSSVRTAFLLLLSFLLGTASAQLSSTFYSTSCPSALSTIKSGVSSAVKSEARMGASLLRLHFHDCFVNGCDASVLLDDTANFTGEKNATPNANSLRGFDVIDTIKSQLESACPGVVSCADLLTVAARDSVVALGGPSWTVPLGRRDSTTASQSAANSNIPAPTLNLSGLITAFSNKGFTTKEMVALSGSHTIGQARCTSFRARLYNETNINTTFATSLKANCPSSGGDNNLSPLDTTSPTSFDNAYFKNLQIQEGLLHSDQQLFSGGSTDAQVNAYSSNSATFMTDFANAMVKMGNLSPLTGSSGQIRKSCGKVN

SEQ ID NO: 497 - protein, 326 aa, Eucalyptus grandis
MAAQKLLSLLVFQLALVAFILDVANAQGLKVGFYKNTCPQAEEIVKKAAASFISRAPSLAAPLLRMHFHDCFVRGCDGSVLLNSTSSNQAEKDAFPNLSLRGYQVIDAAKDALEKKCPGVVSCADILALVARDAVSMMNGPFWQVPTGRRDGRVSNLQDALNNLPGPAFSISALKSSFAAKGLSVKDLAVLSGGHTLGMSHCSSFTNRLYNFTGKNDADPSMDPNYVAQLKTKCKPNDATTIVEMDPGSAKKFDVDYYTLVSKRRGLFQSDAALLTDSTTNAYVQLQLTSKSTFAEDFGVSMVNMGNIGVLTGNSGEIRKKCYLVN

SEQ ID NO: 498 - protein, 350 aa, Eucalyptus grandis
MPHLTSHSSPLTCSSTLFIALILICSQPNGSTAAAAANATGRHRQMSFDYYAKSCPQVEQLIGSVTSQQFKEAPVSGPATIRLFFHDCFVEGCDGSILISSKPGSKELAEKDAIDNKDLRAEGFETIAKAKSLVENKCPGLVSCADILAIAARDFVHLSGGPYYQVKKGRWDGRISKAARVPPNIPRANSTVDQLLKLFNSKGLTLADMVVLSGAHTIGFAHCVQFSSRLYNYKGTKRPDPVIDPRLLKALRMSCPQFGGNKDIVAPFDVTTPFLFDHTYYANLEAKLGLLASDQALFSDPRTRPVVQDMAKDKQKFFQAFGAAMEKMGMIGVKRGRKHGERRRDCSSHG

SEQ ID NO: 499 - protein, 715 aa, Eucalyptus grandis
MEMESTTGTGNGLHGLCAAGSHHADPLNWGAAAAALTGSHLDEVKRMVEEYRRPAVRLGGESLTIAQVAAVASQEGVGVELSEAARPRVKASSDWVMESMNKGTDSYGVTTGFGATSHRRTKQGGALQKELIRFLNAGIFGNGTESCHTLPQSSTRAAMLVRVNTLLQGYSGIRFEILEAITKFLNHNITPCLPLRGTITASGDLVPLSYIAGLLTGRPNSKAVGPDGKSLDAVEAFRLAGIDTGFFELQPKEGLALVNGTAVGSGLASIVLFEANILAVLSEVLSAIFAEVMQGKPEFTDHLTHKLKHHPGQIESAAIMEHILDGSAYVKAAKKLHEMDPLQKPKQDRYALRTSPQWLGPQIEVIRAATKMIEREINSVNDNPLIDVARNKALHGGNFQGTPIGVSMDNTRLAIASIGKLMFAQFSELVNDFYNNGLPSNLSGGRNPSLDYGFKGAEIAMASYCSELQFLANPVTNHVQSAEQHNQDVNSLGLISSRKTAEAIDILKLMSSTFLVALVPAVDLRHLEENLKSTVKNTVGRVARKVLMVGANGELHPSHYCERDLLKVVDREHVFTYADDACSATYPLMQKLRQVLVDQALVNGESELNPSTSIFQKIVAFEEELKAQLPKDVEGVRVQYETGNLAIPNQIKECRSYPLYKLVREELGTALLTGEGVISPGEDFDKVFTAICAGKLIDPLLECLSGWNGAPLPIS

SEQ ID NO: 500 - protein, 715 aa, Eucalyptus grandis; identical to SEQ ID NO: 499

SEQ ID NO: 501 - protein, 715 aa, Eucalyptus grandis; identical to SEQ ID NO: 499

SEQ ID NO: 502 - protein, 700 aa, Eucalyptus grandis
MEMESTTGTGNGLHGLCAAGSGHADPLNWGAAAAALTGSHLDEVKRMVEEYRRPAVASQEGVGVELSEAARPRVKASSDWVMESMNKGTDSYGVTTGFGATSHRRTKQGGALQKELIRFLNAGIFGNGTESCHTLPQSSTRAAMLVRVNTLLQGYSGIRFEILEAITKFLNHNITPCLPLRGTITASGDLVPLSYIAGLLTGRPNSKAVGPDGKSLDAVEAFRLAGIDTGFFELQPKEGLALVNGTAVGSGLASIVLFEANILAVLSEVLSAIFAEVMQGKPEFTDHLTHKLKHHPGQIEAAAIMEHILDGSAYVKAAKKLHEMDPLQKPKQDRYALRTSPQWLGPQIEVIRAATKMIEREINSVNDNPLIDVARNKALHGGNFQGTPIGVSMDNTRLAIASIGKLMFAQFSELVNDFYNNGLPSNLSGGRNPSLDYGFKGAEIAMASYCSELQFLANPVTNHVQSAEQHNQDVNSLGLISSRKTAEAIDILKLMSSTFLVALCQAVDLRHLEENLKSTVKNTVGRVARKVLMVGANGELHPSHYCERDLLKVVDREHVFTYADDACSATYPLMQKLRQVLVDQALVNGESELNPSTSIFQKIVAFEEELKAQLPKDVEGVRVQYETGNLAIPNQIKECRSYPLYKLVREELGTALLTGEGVISPGEDFDKVFTAICAGKLIDPLLECLSGWNGAPLPIS

SEQ ID NO: 503 - protein, 724 aa, Eucalyptus grandis
MEVAAAAVVAAAAAHENGNGHALPCSNGSAKPRDDPLGWGAAAESLAGSHLEEVKRMVGEYRRPVLRLGGETLTVAQVAAAARGAGLTVELCESARPGVEASAEWIMESMCKGTDSYGVTTGFGATSHRRTKQGGALQKELIRFLNAGVFGNGTESCHTLPQSATRAAMLVRVNTLLQGYSGIRFEILEALIKLVNSGITPCLPLRGSISASGDLVPFSYIAGLLTGRPNSKAVGPAGETLTAKQAFELAGISGGFFELQPKEGLALVNGTGVGSALAAIVLFEANMLTVLSEVLSAIFAEVMQGKPEFTDHLTHKLKHHPGQIEAAAIMEHILDGSSYVKAAKKLHDMDPLQKPKQDRYALRTSPQWLGPQVEVIRPSTKSIEREINSVNDNPLIDVSRNKALHGGNFQGTPVGVSMDNTRLAIASIGKLMFAQFSELVNDFYNNGLPSNLSGGRNPSLDYGFKGAEITMAAYCSELQFLANPVTNHVQSAEQHNQDVNSLGLISARKTAEAVEILQLMSSAFLVALCQAIDLRHLEENLKSTVKNTVSQIAKKVLTMGPNGELHPSRFCEKDLLKVVDREHVFAYIDDPCSATYPLMQKLRQVLVDHALANGDEVKANSSIFLKIGTFEEELKALLPKEVDNCRSACESGNEAIPNRIRECRSYPLYKFVRADLGTELLTGEKVRSPGEDFDEVFTAMCEGKLIDPLLECLKEWDGPPLPIC

SEQ ID NO: 504 - protein, 714 aa, Eucalyptus grandis
MDMDTAACNGKGSLGLCTGAGGDPLNWGAAAAALTGSHLDEVKRMVEESRRPVVRLGGETLTIAQVAAIAGREAGMAVELSEAARAGVKASSDWVMESMSKGTDSYGVTTGFGATSHRRTKQGGALQRELIRFLNAGIFGNGTESCHTLPHSATRAAMLVRINTLLQGYSGIRFEILETMAKLLNRNITPCLPLRGTITASGDLVPLSYIAGLLTGRPNSKAVGPNGESLNAVEAFRLAGIEHGFFDLQPKEGLALVNGTAVGSGLASIVLYEANILAVLSEVLSAIFAEVMQGKPEFTDHLTHKLKHHPGQIEAAAIMEHILDGSSYVKDAQKLHEMDPLQKPKQDRYALRTSPQWLGPQIEVIRAATKMIEREINSVNDNPLIDVSRNKALHGGNFQGTPIGVSMDNTRLAIASIGKLMFAQFSELVNDFYNNGLPSNLSGGRNPSLDYGFKGAEIAMASYCSELQFLANPVTNHVQSAEQHNQDVNSLGLISSRKTAEAVDVLKLMSSTFLVALCQAIDLRHLEENLKSVVKNTVNQVAKKVLYVGSNGELHPSRFSEKDLIKVVDREYVFAYIDDPCSATYPLMQKLRQVLVDDALDDVDREKNPSTSIFQKIGTFEEELKALLPKEVENARAQFESGNSAIANKIRGCRSYPLYRFVREELGTGLLTGEKVGSPGEDFDLVFSAMCEGKLIDPLLECLRDWDGAPLPIC

SEQ ID NO: 505 - DNA, 60 bp, Pinus radiata
aatatgcgatatacaacacttagttgtttggtactgatagtaacatggctgaccatcttg

SEQ ID NO: 506 - DNA, 60 bp, Pinus radiata
ttaaatatatgtcgttgggcatgcatctagctgttattttgttggaaatgagcttcatct

SEQ ID NO: 507 - DNA, 60 bp, Pinus radiata
atcttctatcaaacacggaaatgtccttgaaagttagacatgttctttacctattttatt

SEQ ID NO: 508 - DNA, 60 bp, Pinus radiata
gaataggcaaatgttttcctagataattttcagtatagaactttgtttatgcctactaaa

SEQ ID NO: 509 - DNA, 60 bp, Pinus radiata
tcacttttaggttcgttggaatgttggcaataagtcgatttccttcccgacgagcattaa

SEQ ID NO: 510 - DNA, 60 bp, Pinus radiata
ggacactcctgtcttgaggaggactgagattcctctcttcataagtgtgctcaagaccag

SEQ ID NO: 511 - DNA, 60 bp, Pinus radiata
aggaaagtctgaaaagtaggctaaaatctaattggccatgttctctgagaaatcaatatg

SEQ ID NO: 512 - DNA, 60 bp, Pinus radiata
ccatctttgtatgatcagatcttattacagtggaaacgaagaccatatgacttcctaacc

SEQ ID NO: 513 - DNA, 60 bp, Pinus radiata
ttctcgtttacacctatgatcaagactttagttgacaccgttgaaagcttacacaaagat

SEQ ID NO: 514 - DNA, 60 bp, Pinus radiata
ttattacttatctgtcatagtagttaatgtttcaaggcggcctacattgtaatattcagc

SEQ ID NO: 515 - DNA, 60 bp, Pinus radiata
gtttgtgatattattgtttgacattggtatccatattaatatatgatggatgatcgtgta

SEQ ID NO: 516 - DNA, 60 bp, Pinus radiata
gagaatgtctttaccacgatgtcattaccagtgtactatttctgtgatacctactctatg

SEQ ID NO: 517 - DNA, 60 bp, Pinus radiata
tcaaatatatcaacttgtaaactttttgcgactctacgccttcgtggatcaaatatctta

SEQ ID NO: 518 - DNA, 60 bp, Pinus radiata
caggtcaagcaatcagtattgttatcgttgacttgagtgaagtggaagagcaacgagtac

SEQ ID NO: 519 - DNA, 60 bp, Pinus radiata
aacatgcaagtgccaaagatgtttggttggttgcagatgagataaataaaatggtgggat

SEQ ID NO: 520 - DNA, 60 bp, Pinus radiata
ctggtgcgatgtgaaagatagccttggaatcttaggacgctacctgaggacgttgccttt

SEQ ID NO: 521 - DNA, 60 bp, Pinus radiata
ccaatacatacgtttcgctatcacatttgtttaagcgataaatgcaacctcacgggcata

SEQ ID NO: 522 - DNA, 60 bp, Pinus radiata
tatattagtgatattcgaaaacatcgcgatattttcggcaaaacgatatattgcgagaaa

SEQ ID NO: 523 - DNA, 60 bp, Pinus radiata
tgttctatgttcccatacaaaatgcttttataacacataatatataatatgtataccttg

SEQ ID NO: 524 - DNA, 60 bp, Pinus radiata
aatgcaatctcaacggcatatttgccgtacaaggttcagctggtgtagccattgaataat

SEQ ID NO: 525 - DNA, 60 bp, Pinus radiata
aaattgcacgatatgcgacacgtgtctatctaaatcgttgtactatcctatatcttttta

SEQ ID NO: 526 - DNA, 60 bp, Pinus radiata
ttatttaggaactcgatactggtttttgttactttagtttagcttttgtgaggttgaaac

SEQ ID NO: 527 - DNA, 60 bp, Pinus radiata
atcagcctccattggtcagaagtctagaattatggaatgtaccatatgtaacagtttttg

SEQ ID NO: 528 - DNA, 60 bp, Pinus radiata
ctattctcgtgaacacagagataagtctcgtgaataggcaatcgatacaatctttactat

SEQ ID NO: 529 - DNA, 60 bp, Pinus radiata
aaacatttactagtacctatggcatattgttgtaatgacacttgctagtgccaaactata

SEQ ID NO: 530 - DNA, 60 bp, Pinus radiata
ggatctgtcttgggttgaaggatcagctagaatctagactcgcaacggcacacccaaatg

SEQ ID NO: 531 - DNA, 60 bp, Pinus radiata
agaactatggaagtcgtaaaagatatggaatgatgtttgtaagagtagaattggttggtt

SEQ ID NO: 532 - DNA, 60 bp, Pinus radiata
tgtcttttgctgatgtacttttcatggagtcaaaagaatactagtggctgcctggtattt

SEQ ID NO: 533 - DNA, 60 bp, Pinus radiata
attgatgagtgtatcttcaatgcggtggaataaaactgatgccatcatagtgccctaata

SEQ ID NO: 534 - DNA, 60 bp, Pinus radiata
ggaccatcttttcttctatatcaggtttattacacttaccttcatagtacgttaacgaaa

SEQ ID NO: 535 - DNA, 60 bp, Pinus radiata
aaaacattacatcaattattttgatgtaagtagcagcccatttccggatgctattcacat

SEQ ID NO: 536 - DNA, 60 bp, Pinus radiata
gtcctaagttaatgaaggtctcagaattccgtatagtagacttcaccaaggtcgtagtca

SEQ ID NO: 537 - DNA, 60 bp, Pinus radiata
tccattagtatagcagttgtaatttttggctgtgccataattcagaattcagatttgaat

SEQ ID NO: 538 - DNA, 60 bp, Pinus radiata
atggaatttccaaaatatttatggttattatgtatattttatcttaagctgttggtaaac

SEQ ID NO: 539 - DNA, 60 bp, Pinus radiata
aatactgtcatctatagctctatccatgccgtagtttcacctaagcattgccctattttt

SEQ ID NO: 540 - DNA, 60 bp, Pinus radiata
ggctaatggggtcccatttcctaaaagaatgagtgaatggttgttaacaaactattttga

SEQ ID NO: 541 - DNA, 60 bp, Pinus radiata
ttccacttagatagatagtttaatgtctacaatatgattctttaatagtaaataacacac

SEQ ID NO: 542 - DNA, 60 bp, Pinus radiata
gaagaatgcgtattgattccagatgttgcgtgctgggatttcatttaagcgcatgattaa

SEQ ID NO: 543 - DNA, 60 bp, Pinus radiata
atccgccattccacacaaaaatttgtagaagttagactttcaagaaagttgtaagctatt

SEQ ID NO: 544 - DNA, 60 bp, Pinus radiata
ggtggatatgcgcatagtaactgagggagcaactttgacgttaattgcacttcctcgttt

SEQ ID NO: 545 - DNA, 60 bp, Pinus radiata
tctttaagtggtgcccgtcatgtattttacatgtatataatgtctatgtgagtgagtttg

SEQ ID NO: 546 - DNA, 60 bp, Pinus radiata
tagttaaaataatcgtcagacaggaaggctagctgtgtttttttactagtggggattgtt

SEQ ID NO: 547 - DNA, 60 bp, Pinus radiata
catggttacaacttttacttggtgggagatggctacgggaactataacccagacaccgac

SEQ ID NO: 548 - DNA, 60 bp, Pinus radiata
cataaccatcccactagtgtcgtatttgagaaatgcgtgtatatttgcataacctagctt

SEQ ID NO: 549 - DNA, 60 bp, Pinus radiata
tcttccctggtttcgttgaaccagtgtaccattacaaatgctgttctatatagaagtttg

SEQ ID NO: 550 - DNA, 60 bp, Pinus radiata
aatataaatcaataggtggctgacacgtttgaattaccttcctattagtctcgagtattt

SEQ ID NO: 551 - DNA, 60 bp, Pinus radiata
ctgtttcagaacactgcaaagactgtaaatctatccataaaagtgccaaaggtaatataa

SEQ ID NO: 552 - DNA, 60 bp, Pinus radiata
caatttgtaaagcttgacgattattgtcgaactgttaatattacatgttacaagtaaatt

SEQ ID NO: 553 - DNA, 60 bp, Pinus radiata
tgtaaaggattacatctccttatctcagggtaggatagactcccaatgacattagagcat

SEQ ID NO: 554 - DNA, 60 bp, Pinus radiata
aatgcttcacactggtaattcaacaaggggcaaccaattacagtgtggaactgtattgaa

SEQ ID NO: 555 - DNA, 60 bp, Pinus radiata
caaataatgagtttgcaaagccattcgtcctcatagtgtttaatcattccggagaagata

SEQ ID NO: 556 - DNA, 60 bp, Pinus radiata
cagagcatatcgtgggcccaacaaggactattatataggaataagcccttatctgtctgc

SEQ ID NO: 557 - DNA, 60 bp, Pinus radiata
ttgtattcattttcaaaaggctaatgttgagttgtattgtttacgcacataataaatcaa

SEQ ID NO: 558 - DNA, 60 bp, Pinus radiata
aatataacgcgtagcatctaaatacacagtgtgtaaatatgtacacagtggactcgataa

SEQ ID NO: 559 - DNA, 60 bp, Pinus radiata
agatttggcgaccttcgagaatctggtagttgttaattatcaatatctaagtacagctaa

SEQ ID NO: 560 - DNA, 60 bp, Pinus radiata
cggtcagttcatctggttgcggtccccactctcaggttaaaagtatgagatattcgaaga

SEQ ID NO: 561 - DNA, 60 bp, Pinus radiata
tctgaagcccaacttctagcaagcaataactgtatattttagaacaaatacctattcctc

SEQ ID NO: 562 - DNA, 60 bp, Pinus radiata
ttcaggtcagtaaatccaattggcaaaagcaataataatcttttgagattcatgtcgaca

SEQ ID NO: 563 - DNA, 60 bp, Pinus radiata
gatgtatgtatgtcagacctttctggcctatcatcctttccttgcatgtagatgtatgta

SEQ ID NO: 564 - DNA, 60 bp, Pinus radiata
ttttcacaattgtagttaaataaagtgtggatttccaaggtattggtgagttgtcagttg

SEQ ID NO: 565 - DNA, 60 bp, Pinus radiata
aattgtttgtgatcactcattgtaaaagtacaccaattgggcttttaatattatggcttt

SEQ ID NO: 566 - DNA, 60 bp, Pinus radiata
atgtggtttactggttaaataggaaggtttattctttaccagtttaatcgtttaagagta

SEQ ID NO: 567 - DNA, 60 bp, Pinus radiata
atcatgactgtgtgtgcgtgtccactgtcgagtctactaagagctcatagcacttcgaaa

SEQ ID NO: 568 - DNA, 60 bp, Pinus radiata
aagttgttgaataggagcttggcttcgcctgatgtaaagtgaaatgtctgatgttgttga

SEQ ID NO: 569 - DNA, 60 bp, Pinus radiata
ataaaagcttacgttgcatttttcgttgtgctgacttctgtaagaccaacgtagtgcttg

SEQ ID NO: 570 - DNA, 60 bp, Pinus radiata
gctaatttggagatcaatcagcatatcctcaatttgattatattttattttgacatttat

SEQ ID NO: 571 - DNA, 60 bp, Pinus radiata
ttcatgaagtggatcatgcatgactggaacgatgaggactgtatcaagatactcaagaat

SEQ ID NO: 572 - DNA, 60 bp, Pinus radiata
gttttatgttatctggcagtataagatttctgaagacatggttgaaattattgtgagatt

SEQ ID NO: 573 - DNA, 60 bp, Pinus radiata
ttcctcagtgaacagtgtagtaaatattgtaatattcgctcagtctaataaatatagtaa

SEQ ID NO: 574 - DNA, 60 bp, Pinus radiata
ttgctggggtcgttatcatgcagtatatgacctatgttttatgtggtatgtcaatagttt

SEQ ID NO: 575 - DNA, 60 bp, Pinus radiata
ataagctgtcgcgcttccgattatcgttacgataacgttggttttgctggggtcaatagt

SEQ ID NO: 576 - DNA, 60 bp, Pinus radiata
gaacaacttcatagattgctcgttatcctttgaattattgatatagatatcaaaatttga

SEQ ID NO: 577 - DNA, 60 bp, Pinus radiata
gtttaggtatattcctactgtttctttatcgcagaaaattaatgtgtttctaaaccgaaa

SEQ ID NO: 578 - DNA, 60 bp, Pinus radiata
tgatgtctggtttcataatggttgattctgattaatagtgtcacctctataaacttcaca

SEQ ID NO: 579 - DNA, 60 bp, Pinus radiata
atttcagtatcgtcgtttactgtagcaagtcagcttatgctttatttacgaagtataaga

SEQ ID NO: 580 - DNA, 60 bp, Pinus radiata
ttagattgaatgacagtcctgatttactatgtcagcagtgcttacatcttagtcagaggc

SEQ ID NO: 581 - DNA, 60 bp, Pinus radiata
ttcattagagtgttgcagtctgtaactgaagcgttccctggttgagcaccgccatgtttg

SEQ ID NO: 582 - DNA, 60 bp, Pinus radiata
tgggattcatgagaagcgttagaatagcgttcccacaaatcatgtcaaggttctggtcat

SEQ ID NO: 583 - DNA, 60 bp, Pinus radiata
attctctccaacttcaatgatgcaataagcaagaggataaatgtcattatctttcatgga

SEQ ID NO: 584 - DNA, 60 bp, Pinus radiata
tgcaatttaccagagaaaaacttcacgaatttctacagaatttaagttggtaaaaaagaa

SEQ ID NO: 585 - DNA, 60 bp, Pinus radiata
tttatgcacaccatattgttcccccttaaatttacaaagctaaggaattcatatgttagt

SEQ ID NO: 586 - DNA, 60 bp, Pinus radiata
aaagataggtagtcctgtcaatattcttggaaaggccgttagggtgttttcttgcaataa

SEQ ID NO: 587 - DNA, 60 bp, Pinus radiata
tttgaatctgcatgaatgttctttcagtgatctgattccttgttcctctttgatatcaat

SEQ ID NO: 588 - DNA, 60 bp, Pinus radiata
tcgttttagggccaattgcatagagccgattgcggaagtccgacgcgattgtttgattgg

SEQ ID NO: 589 - DNA, 60 bp, Pinus radiata
atatgtttgttaggggtttagttatcagtatttgagttcgaagtaccgattagcataata

SEQ ID NO: 590 - DNA, 60 bp, Pinus radiata
atatctaaatgaccagctataggtcattcttggtctcctttcatcaaatgccttataatg

SEQ ID NO: 591 - DNA, 60 bp, Pinus radiata
tggtcttaattcacttaagggattggagtgttagtaaggccaattcatttaaggtagtat

SEQ ID NO: 592 - DNA, 60 bp, Pinus radiata
gaataaggttaatgatgttcatgtctttccctttcttagtatggccacacgcttatatgg

SEQ ID NO: 593 - DNA, 60 bp, Pinus radiata
gtgtatagtttataataacgcacctggctgttggaattaatgtatttatgtgactcctac

SEQ ID NO: 594 - DNA, 60 bp, Pinus radiata
tccaaagttcggtctatcgttttacatgtacacagtgtgacggacgtctcttaacagatg

SEQ ID NO: 595 - DNA, 60 bp, Pinus radiata
aatactgtgaatttaacagtgaataagaaacaataatggctggcgtggttatcgttgtat

SEQ ID NO: 596 - DNA, 60 bp, Pinus radiata
aagtattctagccggttatcagtcacaagtttttgagatccctagaggactcaacgccca

SEQ ID NO: 597 - DNA, 60 bp, Pinus radiata
attcattgcgttgggttgtgctcaaaagacgtgcaattaccattaactaataaagtatgg

SEQ ID NO: 598 - DNA, 60 bp, Pinus radiata
tccacttttgtaacataaaagttagaaagggaagtgcgtgctatctgtaacatactgaca

SEQ ID NO: 599 - DNA, 60 bp, Pinus radiata
tttgtaaagattgtattatctatagcttttctctgaagttataagcgaagctagctttac

SEQ ID NO: 600 - DNA, 60 bp, Pinus radiata
tttgtctgtatcgattagctattcgtcgcattttcctggaatattaatgccatgccatgc

SEQ ID NO: 601 - DNA, 60 bp, Pinus radiata
tgctcggtgatttcgttccgtccaataattgtagctttcttctgtaatatcatcgccgtg

SEQ ID NO: 602 - DNA, 60 bp, Pinus radiata
ttgattgtagaattatatagatagttgggagacctacggctgcgttagacactagcaagc

SEQ ID NO: 603 - DNA, 60 bp, Pinus radiata
acattcagattaggtcttcaatacggttggaaaattcgtatgaagtatgtagcagactga

SEQ ID NO: 604 - DNA, 60 bp, Pinus radiata
aactccctggtgtacgttatttcccaaccacaacgtctgggtagcagattagagttccct

SEQ ID NO: 605 - DNA, 60 bp, Pinus radiata
tgtaataagttgatttgcgatggcctattgagtcttcaaaccgaagctctaattgaaagc

SEQ ID NO: 606 - DNA, 60 bp, Pinus radiata
tcagcttatattttctttgtaacaaattgattttcgatcggctagttaattgacatgatt

SEQ ID NO: 607 - DNA, 60 bp, Pinus radiata
agtaggagccgcagtcgataattgcgacatcgattttggtatttttcaaaattgtaaaag

SEQ ID NO: 608 - DNA, 60 bp, Pinus radiata
gtaataagttcttataaataaaggtatcctgagaataccctgcgaatagatatcgtcatt

SEQ ID NO: 609 - DNA, 60 bp, Pinus radiata
tattatattgtgtgcctgtggtcctttttttaaccactgttttatcataaaaatgttcaa

SEQ ID NO: 610 - DNA, 60 bp, Pinus radiata
attcataagatccgtgccacaatggtacgcatcatttgtaatattcgcggttatcccgcc

SEQ ID NO: 611 - DNA, 60 bp, Pinus radiata
actcttgtatcagcgagagaagatttagggatgtggattgttaagtttgtactttacagt

SEQ ID NO: 612 - DNA, 60 bp, Pinus radiata
tgtttgcatgaggtgacttctgaccatgaatactctttttcttattagccaataagaaaa

SEQ ID NO: 613 - DNA, 60 bp, Pinus radiata
tagtttacaaattgaataaatggagtaatatattaagcattggaaacggcaggaggacct

SEQ ID NO: 614 - DNA, 60 bp, Pinus radiata
ccatatatgcacgtagaccctgcttgtgtaataatattgctggtcatcgttttgccataa

SEQ ID NO: 615 - DNA, 60 bp, Pinus radiata
ctttattatttatcaatttttcagtaggcagagatcatgtcgtcatctgtgggagaagag

SEQ ID NO: 616 - DNA, 60 bp, Pinus radiata
agtttgaactgtgctcgaattctgaggttcatcgtgcagaagtttgattcgtaaattatt

SEQ ID NO: 617 - DNA, 60 bp, Pinus radiata
agagtagtaattgggtgatggacagtatggccaacgggaaggctatctatggcgttacga

SEQ ID NO: 618 - DNA, 60 bp, Pinus radiata
taggagtgtctaacgaggccaggaattctaacgaggccagttctctgtctagactgttaa

SEQ ID NO: 619 - DNA, 60 bp, Eucalyptus grandis
ttcttaaattcgttaggttgtgatttcggggtttggtgagcattttactggtggggggtt

SEQ ID NO: 620 - DNA, 60 bp, Eucalyptus grandis
cctcagccttttagctcctaaatcgtacgattgttctgaataatgtatcattacccactt

SEQ ID NO: 621 - DNA, 60 bp, Eucalyptus grandis; identical to SEQ ID NO: 620

SEQ ID NO: 622 - DNA, 60 bp, Eucalyptus grandis
aggggaatagattctcgattatcgtgtttatataaagatttctattaggttcatcgctcc

SEQ ID NO: 623 - DNA, 60 bp, Eucalyptus grandis
tcacatgttggtggacaacttttcattgatctcgaacgaatggagtcgctttaatccttg

SEQ ID NO: 624 - DNA, 60 bp, Eucalyptus grandis; identical to SEQ ID NO: 623

SEQ ID NO: 625 - DNA, 60 bp, Eucalyptus grandis
aagttcttccctgagtataacgtaccgaccaagtgctctgatgaggtgaacccaagagta

SEQ ID NO: 626 - DNA, 60 bp, Eucalyptus grandis
tgacatggttacaattaacccagctatggtgattggtcctcttttgcagccaacacttaa

SEQ ID NO: 627 - DNA, 60 bp, Eucalyptus grandis
cttcttggcctgctgatcgagtgaaggctgaagattgctggactgatcttgactactgca

SEQ ID NO: 628 - DNA, 60 bp, Eucalyptus grandis
tttgctaaactaaactaatcgcagtgtttcagtttttatgtttgtttaatcccttggtcc

SEQ ID NO: 629 - DNA, 60 bp, Eucalyptus grandis
aagctgaagagtctgtatcctaactacaattatcctcatagctttactgagaccgaagaa

SEQ ID NO: 630 - DNA, 60 bp, Eucalyptus grandis
caaactcgacgcaaagttggatttcattggaataaatcactacacgactaaatacgcgaa

SEQ ID NO: 631 - DNA, 60 bp, Eucalyptus grandis
gtggagaggctaactttcaagattttttacaccatccttgctccataaataaacagtcgc

SEQ ID NO: 632 - DNA, 60 bp, Eucalyptus grandis; identical to SEQ ID NO: 631

SEQ ID NO: 633 - DNA, 60 bp, Eucalyptus grandis
tccacttagcggtgtatccaatatgtttccgcgcactaatcaatcgtgtcgtgctgttac

SEQ ID NO: 634 - DNA, 60 bp, Eucalyptus grandis
tatccagttatttactgaatgtactgcatgtttagataacatcaatggcatgatttatca

SEQ ID NO: 635 - DNA, 60 bp, Eucalyptus grandis
attggactttatcggcatcaatcactacacaagttactatgtgcaggactgtattttatc

SEQ ID NO: 636 - DNA, 60 bp, Eucalyptus grandis
catccacctacaaaatgtagcatcctgtgtctttaaaactattaagagatcatatctttc

SEQ ID NO: 637 - DNA, 60 bp, Eucalyptus grandis
ttcctggttccttgaggtgcgagtcattttcttgggtagcttcattcacgattcaggttc

SEQ ID NO: 638 - DNA, 60 bp, Eucalyptus grandis
ccaagtcaatcgtccttatgcctcgtcatgcttaaatttatgtacgtaatttcaggccct

SEQ ID NO: 639 - DNA, 60 bp, Eucalyptus grandis
ccttttaccactctcaatctaagttacaccaccgattgtcattgtaatatgaccgctgag

SEQ ID NO: 640 - DNA, 60 bp, Eucalyptus grandis
ccatcgcttactgaaagaataagaaatcatattgttccaacattctactcaggtttctgg

SEQ ID NO: 641 - DNA, 60 bp, Eucalyptus grandis
cattgggtgacagtaaacgagcccaattactttacgatattggggtatgcgatgggtatc

SEQ ID NO: 642 - DNA, 60 bp, Eucalyptus grandis
tttggatggatctaaccatacccgtttgcgtgattgcttcgctgggtgtttaggtgcaga

SEQ ID NO: 643 - DNA, 60 bp, Eucalyptus grandis; identical to SEQ ID NO: 642

SEQ ID NO: 644 - DNA, 60 bp, Eucalyptus grandis
gtccaatgtgaaaagcgggttttgacttttgatggaattgatgcggacggtacagtcaca

SEQ ID NO: 645 - DNA, 60 bp, Eucalyptus grandis
cagaagatatacccaaacattgaagtgataccgatcgattacgccaacgaagctctggag

SEQ ID NO: 646 - DNA, 60 bp, Eucalyptus grandis
gattcgctcgactacatttttgacactatccctgtggttcaccctctcgaaccttacctg

SEQ ID NO: 647 - DNA, 60 bp, Eucalyptus grandis; identical to SEQ ID NO: 646

SEQ ID NO: 648 - DNA, 60 bp, Eucalyptus grandis
cttacacttacgatctcaggagcacgggtcctgaagatgcttacatcagggtgctctact

SEQ ID NO: 649 - DNA, 60 bp, Eucalyptus grandis
aagtgacaccatcaattgtcgaagtagtgaactttcagtttttacatgtcttcaataatg

SEQ ID NO: 650 - DNA, 60 bp, Eucalyptus grandis
tataatcagtgactgttaatgttaagccttttgcgtgccataacaagggttaattatgtg

SEQ ID NO: 651 - DNA, 60 bp, Eucalyptus grandis
aaactgaggcgattgaaagactaggtgccgattccttccttgtaaccagtgaccctgcaa

SEQ ID NO: 652 - DNA, 60 bp, Eucalyptus grandis
aattggaggacgtaccgaaagctcttgacatactgaagcagtcaaattgcgtcaagattt

SEQ ID NO: 653 - DNA, 60 bp, Eucalyptus grandis
gatggtccgtatgtgtgtaattctctgcagtaagaatccattagtaagtgagaacgttcc

SEQ ID NO: 654 - DNA, 60 bp, Eucalyptus grandis
tttggtcatggtgggtgcacctgatcagcccctcgaattgccttccttccctctaatttt

SEQ ID NO: 655 - DNA, 60 bp, Eucalyptus grandis
ggcttggggcttatcggatacaaatcactactcccataattgcagacactatttatctat

SEQ ID NO: 656 - DNA, 60 bp, Eucalyptus grandis
gcttgagataatcgagtacatgtccaagatatgcccgattaagacagtcgggccgctgtt

SEQ ID NO: 657 - DNA, 60 bp, Eucalyptus grandis
caacttcttgtgggtcatgaagcctccacacaaggactctggctatgaggttctcaaaat

SEQ ID NO: 658 - DNA, 60 bp, Eucalyptus grandis; identical to SEQ ID NO: 657

SEQ ID NO: 659 - DNA, 60 bp, Eucalyptus grandis; identical to SEQ ID NO: 657

SEQ ID NO: 660 - DNA, 60 bp, Eucalyptus grandis; identical to SEQ ID NO: 657

SEQ ID NO: 661 - DNA, 60 bp, Eucalyptus grandis; identical to SEQ ID NO: 657

SEQ ID NO: 662 - DNA, 60 bp, Eucalyptus grandis
caagataaggttagtgataaaggtgtgtagggagaaacgtgttcggattggccgctaaga

SEQ ID NO: 663 - DNA, 60 bp, Eucalyptus grandis
tccattcctcctatttcagcccgtcatatatgacgcttatgttgctaggtcttgaatctt

SEQ ID NO: 664 - DNA, 60 bp, Eucalyptus grandis
tcgaaatagatcgtgaatttacatacatgatcattattctatgtctatcgttgtatctaa

SEQ ID NO: 665 - DNA, 60 bp, Eucalyptus grandis
ctgagcagggtttcaaagtcatatagcgaacagccttgtacgtagcataagttccgtccc

SEQ ID NO: 666 - DNA, 60 bp, Eucalyptus grandis
gtgaaggagacacctattcagatgttatgtgggacgaatcagaccgtattgactgtgaat

SEQ ID NO: 667 - DNA, 60 bp, Eucalyptus grandis
aatcatctgtattttgtaccgaattatgcacttttgcatcatttttaaaagtttcaattg

SEQ ID NO: 668 - DNA, 60 bp, Eucalyptus grandis; identical to SEQ ID NO: 667

SEQ ID NO: 669 - DNA, 60 bp, Eucalyptus grandis
caaggaatatgttatcatcttggctgaatggtggaaagcggacaccgaaaccgtgatcaa

SEQ ID NO: 670 - DNA, 60 bp, Eucalyptus grandis; identical to SEQ ID NO: 669

SEQ ID NO: 671 - DNA, 60 bp, Eucalyptus grandis
aattaaactactatctttaggaaatcgcacattaattttggtgtatatgcggttaggcat

SEQ ID NO: 672 - DNA, 60 bp, Eucalyptus grandis; identical to SEQ ID NO: 671

SEQ ID NO: 673 - DNA, 60 bp, Eucalyptus grandis
tattcgtattccgtaggaaatttctttaaagaacaagattctgccatttgctaagttgca

SEQ ID NO: 674 - DNA, 60 bp, Eucalyptus grandis
gcagacgggccgtcatacattacgcagtgtccgattcagaccaaccaaagttacgtttac

SEQ ID NO: 675 - DNA, 60 bp, Eucalyptus grandis
gagaaagacagtacaacagctcaactgcgaccatgaatgcggtcgagtattttaatgatc

SEQ ID NO: 676 - DNA, 60 bp, Eucalyptus grandis
ctctcttctctgcatggctcgaggcaatgtccatcactacgatttcgtgctgaaggaaac

SEQ ID NO: 677 - DNA, 60 bp, Eucalyptus grandis
ctgaatacgttacgcagtgtccgatccctccggggactaacttcacttaccaagtcttgt

SEQ ID NO: 678 - DNA, 60 bp, Eucalyptus grandis
gaagttgctgatcaagaataaaacaacctgtgatcatattatatccacaggctgcgtatg

SEQ ID NO: 679 - DNA, 60 bp, Eucalyptus grandis
aaactacacgaggctgtgcagtacaaagagtatgttagtcgttaatgacagttttccggg

SEQ ID NO: 680 - DNA, 60 bp, Eucalyptus grandis
gaggaatattccaatacaacggcacttataaccactcagagactcccgtgttacctgaac

SEQ ID NO: 681 - DNA, 60 bp, Eucalyptus grandis
gccgtaaaagttctgaattacaacgaaacggtagagatagttttccaagggactaatttg

SEQ ID NO: 682 - DNA, 60 bp, Eucalyptus grandis
tttgcctgatagcaacccccatgactggttgacgttacattccgatactaccaatagaaa

SEQ ID NO: 683 - DNA, 60 bp, Eucalyptus grandis
aagttgatgtacctcgcttaccgtatttacaagctatcgtaaaagaaactttccgacttc

SEQ ID NO: 684 - DNA, 60 bp, Eucalyptus grandis
aggactgcacagtgaacggcttccatatacccttgaagtcgagagtcatcgtgaatgtgt

SEQ ID NO: 685 - DNA, 60 bp, Eucalyptus grandis
tcttgtacttgattatgatcaagcgtcttaaaattgtatggtacaatattctagtatgca

SEQ ID NO: 686 - DNA, 60 bp, Eucalyptus grandis; identical to SEQ ID NO: 685

SEQ ID NO: 687 - DNA, 60 bp, Eucalyptus grandis; identical to SEQ ID NO: 685

SEQ ID NO: 688 - DNA, 60 bp, Eucalyptus grandis; identical to SEQ ID NO: 685

SEQ ID NO: 689 - DNA, 60 bp, Eucalyptus grandis
cttttcacatgttcattcaataattgtcgcttcacatacaaactaaaaggccaaagattt

SEQ ID NO: 690 - DNA, 60 bp, Eucalyptus grandis
ctcgaaattatttggcgccttcaacatagccgattttatcccgtacctgagctggatcga

SEQ ID NO: 691 - DNA, 60 bp, Eucalyptus grandis
cttcatacgcgatttgcatctcagtcgcaagttgtatctctatgctagtggtcctgtgag

SEQ ID NO: 692 - DNA, 60 bp, Eucalyptus grandis
gaagtgtaccaattcaatgtgccgactttcggacctggagttgtattcgacgtcgattac

SEQ ID NO: 693 - DNA, 60 bp, Eucalyptus grandis; identical to SEQ ID NO: 692

SEQ ID NO: 694 - DNA, 60 bp, Eucalyptus grandis
aaaataacagcttttatgtcctttgagaactgaaacttatcttttgaaaaaattgtttat

SEQ ID NO: 695 - DNA, 60 bp, Eucalyptus grandis
ggacaacgttctatacatcgtcgagaacatcaacgttgcggcgatcgagacgacactatg

SEQ ID NO: 696 - DNA, 60 bp, Eucalyptus grandis
catggctcgtcttacctccttcgtttatgcaactctccttgcatccacgctcattattct

SEQ ID NO: 697 - DNA, 60 bp, Eucalyptus grandis
ttttcttcgagcaagtctagtgatatttcacgatcactacttaaattgttagagaaatct

SEQ ID NO: 698 - DNA, 60 bp, Eucalyptus grandis; identical to SEQ ID NO: 697

SEQ ID NO: 699 - DNA, 60 bp, Eucalyptus grandis
ggaggagacattctaaaggccgtccctaaagcagatgtccatttcatgaagtcggttctc

SEQ ID NO: 700 - DNA, 60 bp, Eucalyptus grandis
tcagtttgaggatggcttcactacgttaacagatgcattacttatggtcggagtgttggt

SEQ ID NO: 701 - DNA, 60 bp, Eucalyptus grandis; identical to SEQ ID NO: 700

SEQ ID NO: 702 - DNA, 60 bp, Eucalyptus grandis; identical to SEQ ID NO: 700

SEQ ID NO: 703 - DNA, 60 bp, Eucalyptus grandis
gttcgagtatcatggcaccgacccgcgattcaacaagatctttaaccggggaatgtctga

SEQ ID NO: 704 - DNA, 60 bp, Eucalyptus grandis; identical to SEQ ID NO: 703

SEQ ID NO: 705 - DNA, 60 bp, Eucalyptus grandis
ggcatagaacatgtgggaggggacatgacaaactacattcctaaagcggacgtcattatc

SEQ ID NO: 706 - DNA, 60 bp, Eucalyptus grandis
tcccgcatcgatcttaccttacgctatgtcgtattgtgtccaactttgcatttccaatta

SEQ ID NO: 707 - DNA, 60 bp, Eucalyptus grandis; identical to SEQ ID NO: 706

SEQ ID NO: 708 - DNA, 60 bp, Eucalyptus grandis
ttaataatgttaaaatatgtctcaagtttgaacccattgaataatactcggtgtaaataa

SEQ ID NO: 709 - DNA, 60 bp, Eucalyptus grandis
tctcgagtttgagcctatattgaataatattctgtctaaataaattagattgactgccct

SEQ ID NO: 710 - DNA, 60 bp, Eucalyptus grandis
gagaatggaatcgctcgatgatactgaagcaaccctgagaggccaagcgcacatatggaa

SEQ ID NO: 711 - DNA, 60 bp, Eucalyptus grandis; identical to SEQ ID NO: 710

SEQ ID NO: 712 - DNA, 60 bp, Eucalyptus grandis
cctgtacttggcttgcgatctcttattgaggtctacccttcatgatcgattatcaatact

SEQ ID NO: 713 - DNA, 60 bp, Eucalyptus grandis; identical to SEQ ID NO: 712

SEQ ID NO: 714 - DNA, 60 bp, Eucalyptus grandis
tctgatacgttgtttagtctttgtttctcggccacttactcagacctgcatgctcacctt

SEQ ID NO: 715 - DNA, 60 bp, Eucalyptus grandis
catgaagaaaatactcgatgtctacagagggtttgaaggcatcgaagtgctggtcgatgt

SEQ ID NO: 716 - DNA, 60 bp, Eucalyptus grandis; identical to SEQ ID NO: 715

SEQ ID NO: 717 - DNA, 60 bp, Eucalyptus grandis
ttttagcgtgatttaagaatcgtgtctttagtttgtttggtctaccattcaaggaaacct

SEQ ID NO: 718 - DNA, 60 bp, Eucalyptus grandis
atccaaactttgtctgatgcaaaagcatagagagcgaaaaatgagttccgctcaaaacca

SEQ ID NO: 719 - DNA, 60 bp, Eucalyptus grandis; identical to SEQ ID NO: 718

SEQ ID NO: 720 - DNA, 60 bp, Eucalyptus grandis
gccagaaccttcggctcatattggacaagttcccaaatctcaggggcatactctatgatc

SEQ ID NO: 721 - DNA, 60 bp, Eucalyptus grandis
actccatgatgcttctggtatgatgttgttctttcttttcttcttagcctctgtcggatt

SEQ ID NO: 722 - DNA, 60 bp, Eucalyptus grandis
ttctgcatactgatttcacagaatgtgtaacgaaacggcgtatatggatgtgcctgaatg

SEQ ID NO: 723 - DNA, 60 bp, Eucalyptus grandis
gaggcgattctccccgtggttccagagagaaatgtctcttcgaacattgtgttccagcaa

SEQ ID NO: 724 - DNA, 60 bp, Eucalyptus grandis
aagtagcaaaagtttgacagtatttgtaatcgaccgacttataatcatgcgagaataaat

SEQ ID NO: 725 - DNA, 60 bp, Eucalyptus grandis; identical to SEQ ID NO: 724

SEQ ID NO: 726 - DNA, 60 bp, Eucalyptus grandis
tctgccgtcggatcagctgagcatctaatctcaagtccttatgatcagggttcattctta

SEQ ID NO: 727 - DNA, 60 bp, Eucalyptus grandis
ctgtcttatattgtctttgaaccgttgagcatgtatttgtattcaaatgaacgattaagg

SEQ ID NO: 728 - DNA, 60 bp, Eucalyptus grandis; identical to SEQ ID NO: 727

SEQ ID NO: 729 - DNA, 60 bp, Eucalyptus grandis; identical to SEQ ID NO: 727

SEQ ID NO: 730 - DNA, 60 bp, Eucalyptus grandis; identical to SEQ ID NO: 727

SEQ ID NO: 731 - DNA, 60 bp, Eucalyptus grandis
gcaagcgaatttcctaaagctacagcatggtcgaacctgcataattcttggtttatctgt

SEQ ID NO: 732 - DNA, 60 bp, Eucalyptus grandis
tcaccacaatcacggagttatatattataccaagatttccgcgttaaccttacgccggag

SEQ ID NO: 733 - DNA, 60 bp, Eucalyptus grandis; identical to SEQ ID NO: 732

SEQ ID NO: 734 - DNA, 60 bp, Eucalyptus grandis
actgaattctgtgaaggttatccttaagataaataaaagcacattccgcataccttatgc

SEQ ID NO: 735 - DNA, 60 bp, Eucalyptus grandis; identical to SEQ ID NO: 734

SEQ ID NO: 736 - DNA, 60 bp, Eucalyptus grandis
aaatgacgtgaccccttataagtgtgggtatgtatcagctggggttaactttgtcttgct

SEQ ID NO: 737 - DNA, 60 bp, Eucalyptus grandis
tgtgacacattataagtgtgggtatgtatcagctggggttaactttgttatgctaggatc

SEQ ID NO: 738 - DNA, 60 bp, Eucalyptus grandis; identical to SEQ ID NO: 737

SEQ ID NO: 739 - DNA, 60 bp, Eucalyptus grandis; identical to SEQ ID NO: 737

SEQ ID NO: 740 - DNA, 60 bp, Eucalyptus grandis
gcagatctataccagctagcaggagttgtcgcagtagaagtcactggaggtcccacaatt

SEQ ID NO: 741 - DNA, 60 bp, Eucalyptus grandis
gctttagctttttaggttcatcagtgggaatggataaaaagaagtgcacatgggtgtgaa

SEQ ID NO: 742 - DNA, 60 bp, Eucalyptus grandis
gtgttttcgttgcgtgtatgtgatattaaagcacaatgagatttaaagatcaggcatggt

SEQ ID NO: 743 - DNA, 60 bp, Eucalyptus grandis; identical to SEQ ID NO: 742

SEQ ID NO: 744 - DNA, 60 bp, Eucalyptus grandis
agcattcttatgtgctttaaagccgttgtactataggaggtttaacctttaaggtaatct

SEQ ID NO: 745 - DNA, 60 bp, Eucalyptus grandis
tcactaagttccaattactacgacaagacctgtcccaatgctgagttgatcgtcgcaaat

SEQ ID NO: 746 - DNA, 60 bp, Eucalyptus grandis; identical to SEQ ID NO: 745

SEQ ID NO: 747 - DNA, 60 bp, Eucalyptus grandis
gggttgaggataatgggagaagcacgcagtggagtgggatttttatatttgtattcattt

SEQ ID NO: 748 - DNA, 60 bp, Eucalyptus grandis
cattgggatgtttggtcccacttttaatatttatgtatgagcacttaaaagtagtgttca

SEQ ID NO: 749 - DNA, 60 bp, Eucalyptus grandis
caaagtagggttctacaagaatacgtgccctcaggctgaggagatagttaagaaagcggc

SEQ ID NO: 750 - DNA, 60 bp, Eucalyptus grandis
aaggacattgtcgcaccgttcgacgtgaccacgccatttttgtttgaccacacgtattac

SEQ ID NO: 751 - DNA, 60 bp, Eucalyptus grandis
tattagcatacgacctcttgtatcggacccggatccgctatcgttaacgtacacacgttc

SEQ ID NO: 752 - DNA, 60 bp, Eucalyptus grandis; identical to SEQ ID NO: 751

SEQ ID NO: 753 - DNA, 60 bp, Eucalyptus grandis; identical to SEQ ID NO: 751

SEQ ID NO: 754 - DNA, 60 bp, Eucalyptus grandis
ttctgtttggtcctttttgtctcctcccaagtgaagaaattggagaatataagtacttga

SEQ ID NO: 755 - DNA, 60 bp, Eucalyptus grandis
ttgccttctaatctctctggcggtcgaaaccccagcttggattatggttttaaaggtgca

SEQ ID NO: 756 - DNA, 60 bp, Eucalyptus grandis
tcttattcaaacaccccccctcgatgtatatttggacttggaacttcatcggtgtaacaa

SEQ ID NO: 757 - DNA, 10659 bp, Artificial Sequence
  Description of Artificial Sequence: Synthetic DNA construct
ggccgcatttaaatgggccctcgagagcccgggctcctgcaggtaccttaattaaaagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttccccagatccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggcagtccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgatagacaactgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggtttttcttttcaccagtgagacgggcaacagctgattgcccttcaccgcctggccctgagagagttgcagcaagcggtccacgctggtttgccccagcaggcgaaaatcctgtttgatggtggttccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccacggccgctctagaactagtggatcccccctacgtgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatccctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctggagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatctgttaatcagaaaaactcagattaatcgacaaattcgatcgcacaaactagaaactaacaccagatctagatagaaatcacaaatcgaagagtaattattcgacaaaactcaaattatttgaacaaatcggatgatatttatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaaggatatcctgatccgttgacggcgcgccaagcggccgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcacggataacagagtctttatattaaacgaaatggtattgcagtgccggccaggacaccagtattggcttcaactgaccgacgaaaagaaaaatataacataagagggtctgaaacagacaaacaacactaacacatacataaacacaatttattcgtgagaaatacgacaaacactgaacatcacccgaatttattatccacaaataacacccatcgataagcttccagatttctggtggagctccagacaactgctggacgaattcctgcagatcgatcaatcattcgatcaatagagaggacagagaaggcgtggactcggcacggcggtgagtcgaatcgctcttggcgcggtgagtccaaacacatcattcatctcgagttcactcggtttcatcccgtccggcaactcccacgtgaaacagtgaaggaggtgagccacagtcgtctctagcgcgtagagtccgagttgcataccggggcaagaccgacgacctgacccgaatgggatgaactcgaagttgttccctttgaaatcgggcacaccgtctttgagaaacctggagggcctaaacgtatctgggtcggcccacgagttcttgtcccggccgatggcgcacgcgttgatcatcacccgcgatttcgccggaatgtagtagccgccgacctcggcgtcctcggcagtctcgtggaggaggagtgggatgggtgggtggaggcgaaggacttccttcagtacgcatttcaagtaggtgagcttctcgaagtctttctcttcgactcgccggtcaagacccaccaccacggcgagttcttgttggaccttctttagatcttctgggcttttcatcagctccgtcatggcccattcaatcgcggacgccaccgtttcggtccctccaaacattacgtccatgatagctttgatgttgtctttggtgagtttgatggaattttgaagatcgtcagattcgcttactttggcttcctcaccgtaaaaagcaagtaaatcatctaccatatcagtatcaacctcctccgagtttttactccccttctgtatatgatcgtcgatgatcttgtcaataaacccatcaagcgcccctcgtgccttgttgagcctgacgttaatcccctgaggaacccatttgagccaagggataaaatcagctatattaaaagcaccaaacagctgcgaaaactcttgcagtatggccacgaactcgtcctggtcctcatgcgagatcgtcccaaaagccgccctgtaagtaatattcttcgtcagagcaaaaaccagctcgccgatattcaccgtcgacccaatattggacgcgaccactcgtactgccgagtcgacctcgtctcggaccgactcccacgactcggctcgtttccggctaaataatttcatgacgcagagtttacgcatctgacgccaaaacgggccgtagtgagcgaaggccatgtcggctcggtcataggtgaggtagctgatggctatggtggctggccggttcgagaagatgttgtcttggacttgaaggacttggcgagccatgtcgggtgtggaaacggccaccatgtgtaagaatcccatcttgaggtggaatagaccgccgtattgtttggcgagtttggcgagtcctcggtgagtgagttgatccatcatgagcatgtttccgatcaccggtaagccttttgggcctggtgggtatggtagtctctggcgaagccgagatactaggcccaataagagtagcaaaggtataatgaagaacagcgtcatgggtagtggttgcaaggcttcatgaagagaagaatccatggcctgcagcccgggggatcgcttgaaattgaaatatgactaacgaatatacctgcacatcatcacaagctaattagacagatacttcaaggaataaataattcatcacccaaatacagaccaacggacagattctgcgaaagaagcacaaaagaagagggcagacaccctagcaacccatagttacaacctgaacacaaatattaacaagaaatcaaaaagaaagagacaccctaaaatacagttgcaatagaaataaaatatggcaccagcaatccacgaattagaaaaagaaccatcagttcgaaggataagaggaagaaaatatgtgacatgtgacatgtcaatagtaacgcacaaaccctaacagcttacacatagaggaccttatagggaaagcacatcactgtgaataatcacctaccctcagaacccgggcccaaaattaaaatattactacagaacgccacaagaaaatgctcaaagaagaaagggttcctgtgagatcaaaggagggaaactataacaaggttggagacaaaatattaaagtacaacgcaataatctgcaaaggccttctgaaacacatgacgcaataaaacgcaaacacctgctgaaacctttacagacaagagcctattacaaacagcgactactcataacttacatacgaaaattaaatattccagagagacagacctattaagggaagaaaacacagatgaaagcacgaaagccctagtaatgtcagccatagtcgagaaaaataacccaaataaacatgcgaaacccaaaaggacctggcaaaagattcttcccccacagaaaccaccattaacaatttacaaagaaaaacaaatgttaagagtaaagcccttcaaaactccatacctttgaatgaaaagctctctgagaatatcgcactgattatacaacgcaagagaaaagatgagaagtaacgcggtgaaggcgagtatttaatagcgttggatgagacccttctcccgctacgcgacacgacaacagacgacctgtcaccatcggtggttgcgtaccagcggggataacaacgacattttccaatagagaaatgacacgtgtatactgtgcgctggctgtgtcggtgggttatacagggtcatccggtcgcacatccgtcacgcttctcgagacgtatgtaaagcgcgtctgtaggattccaactccgcgtggaccccacaataaattactttttaatacaaaaccagggagataaaagattctcgttcgagggatctccgatatgtcattatgccatttaagtaaaataaataaactttttgtttttttaagtaaataaaagaaataaattgttggtttgtgaatacttttatttactttatttctttatctactcttaaggaatgtaattaacggtgaagtaggaaaagttttacggttaggggaggagttgctttgaaagttatgaaaattctagttatatttagagaaaatccgatacggatttttgtagatccaagttatttttgttaaacttcaaaattttaggtgtcctgaatgtttttgatggtgctgaatctatttccatcataaaaaacatgattcaagcactccctctacaaaaaaattttaatcttttttaccgggattccggccacttttaactgtctagggaattcctccgcctcctggttagacgattccaatgtcttatcctctcaaacttgtacatcaatatttgttcactttggttttctttttgacttaataatacatagattttttactctataatccttggattttcttgaaagtaagtttggtagatggatttttccattgataaatcttgttgacttggtgaacatctttccaactatgggcaatttgtccaagtggatcttctagactcctttgagtggatatatttatacaattttgatatgatttaggaagtaatgtagtttttttatatcaatgtagttagttttttccaacattcaggattgtaacggttggtgggaaaggtagtggagagtttgataattaaataaagaattttttttatgtatttgtgaggggttttgc

SEQ ID NO: 758 - DNA, 11004 bp, Artificial Sequence
  Description of Artificial Sequence: Synthetic DNA construct
ggccgcatttaaatgggccctcgagagcccgggctcctgcaggtaccttaattaaaagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttccccagatccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggcagtccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgatagacaactgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggtttttcttttcaccagtgagacgggcaacagctgattgcccttcaccgcctggccctgagagagttgcagcaagcggtccacgctggtttgccccagcaggcgaaaatcctgtttgatggtggttccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccacggccgctctagaactagtggatcccccctacgtgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatccctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctggagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatctgttaatcagaaaaactcagattaatcgacaaattcgatcgcacaaactagaaactaacaccagatctagatagaaatcacaaatcgaagagtaattattcgacaaaactcaaattatttgaacaaatcggatgatatttatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaaggatatcctgatccgttgacggcgcgccaagcggccgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcacggataacagagtctttatattaaacgaaatggtattgcagtgccggccaggacaccagtattggcttcaactgaccgacgaaaagaaaaatataacataagagggtctgaaacagacaaacaacactaacacatacataaacacaatttattcgtgagaaatacgacaaacactgaacatcacccgaatttattatccacaaataacacccatcgctagaagtactctcgagttttttttttttttttttttttttgacgaagaaagcgtatcagtatcttggaactgcgctagcaagcggggtgtagaaccaaaatgtgcatcttccacacactccaaagttcaaaacaggaacgttctcacttactaatggattcttactgcagagaattacacacatacggaccatcatgcatgttcgatgatgttcaatgcacctgccaaactataatcttcctgaatatgcttcaagatctgtgacaaacaaactgagccagacaatcggccttaatctcccagccaaatttttatttggacaccaaaatttttacttgacaccatcataggcaatctaatcagagtctctggagcctcatgcttcttttaaggtgttgccaatatctatcacaaaccggtacttgacatcgcccttggcaaggcggtccattgctgtgttcacatagtcgatagaaatgacctcaatatcggcggtaatcttgtgctttgctgcaaaatcaatcatctcttgagtttcttgtattccaccaatgcaactcccagccacaatcttcctcccaaagatcaatgggaaaacgggtaactcgagaggccgatcaggagctccaacgagaacaagctttccgttctgtttgagcaaaccaatcaaaggcaatatcgggtgcacagccgaaaccgtgtcgattataccatccattgtgcccattgcagcctgaacttgattggtgtcgctgctaataaggaatgcatcggcgccgagacgctggagcgcttcctccctcttcccgggagaggagctgatcacggtcaccttgacccccatcgccttcgcaaattttactgcaacatggcccagtccaccgagacccaccaggcccaagtggatccctgggtggtcgagcccaaagaacttcattgggctataaacagtgatcccggcacaaagcaaaggagcgccggcatcgagaggcatgttttgcgggaatttgatggcgaagtgctcatccaccaccatcatgttggagtatcctccgtgggtcatcgtcccatcatggtacatggcaccataagtcagaatcattttggggcagtaattctcgagttggtcgtggcaactatcgcaggagccgcacgatccgaccaggcaacccactcccactttgtctcccgccttgaacttctccaccttgctcccaacctcaacaacttcgcccacaatctcgtgcccgggaacaagaggataagtcgagaatccccactcgttcctcacgctgtggaggtcgctgtggcagattccgcagaaaaacaccttgaacttcacgtctttctctcccgttgtcctgcgggagaatttgaagggagacaggaggccggaggggtctctcgcagcccagccgaaagccgcctgcgggtgctcttgctccggcgacttcgccattttttccccgatgcaatggaaggattttctcttcttcttgttttctcgtgactcgtgccgaattcgataagcttccagatttctggtggagctccagacaactgctggacgaattcctgcagcccgggggatctggacagtgaagaagtggtacttgaagaaggcttttggttgtgtgaggaaagaggagggagagagtggcaatttatttgaaatctgggaaagagagtggtgctcatcaaagtgggagaaaatgaaattaggtgagaggttccaatttttagttaggggaattcagtagttagcacctcaatgataagtgttgtgcgaaaagcaaaaacatggatggaataaatggagagagagagagagagagagagagccgggggatcattcactgttacagcaactagtttgcttgagaaagcaggaaaaatggtagagggagatcaaatggacatggcacaaatcaggccatgcgtgattgcttgggtttcactttgtatttatttctggtacaaaatcaatttgcctgccaacaaacttaggaggaaagcttttgcagcttccttatcttttgcgagggagatgaatcgagattcatgtttgctgcagaaaatagggcccaacactctcatcaacttgattaggattgagttgacttctgcatagcaactttggttgtgcgaatttccctttcctttttttcccgagtaccttgttattcattattgaaaggtgaaacataaagtggggtaatccagacttgcaagcaccaaacagccaatggttttagatatttgcatttgtcagctgtgattgaaaagaaagaaaaggcatctgttaccaatcaaacattcgacctaaggattaagacttgccagtgccatccatccgctctgtaaggcatcgctggatccatattaaagaggaaacagacatttcacctcacccccatcaatccttgttaggttctctagatgtctagttacaaacaaggtgattgcctctgcggaacatacatgagaaatatcatccacttgaaaaactgacatcttcgccactttagttcgaatggactaactaaaatcccaaccatttaggatttgttataatcttctcctcaatgattgaaatgtaagttctttccatgtttgcagcagagagcagactcttttatgctattgaaaatgatctttctcgcacgaactgttcgctacacttgaacccccttcatgtcgtgctgtacattaaaagaatgcattcgaagacttgttacagcggttctctacagttctgcgtcactgccgatggcttgtataagacaccttttgccacggcggcccaacagctaatcttcaacacctatcgtctggttaatttgatattactcattacacacacccacacacacagagtgcgataacataaatgacagtcatcagtaagattcataatcaatcatctcagcatgatctgtccatcactataacaacatttgcctttccatttctgatggctggcgaacacgcgatggtttaatcatctttgattataacctgcttcctaagctaaaaaaaaccagagcttacagcagtgactgtgtgaatccagttcgtagggatctggatatccattcttaaaaactatattgccaagatgcaactctcctcattagactccccgggttttcgtgaatagattgacatagattgatctgaatatctttagtataacgcaaaacagatataacataggccgagaatcagattaactacaaagtacttgtccatgacagattaattacaaaacacctaactccccagaagaagctatcccaccatccatgttagcagggcatgagactatttgctgaaaaaattaccagaagtataagcatttctcttctccaatgtaacatgcgaaaaaattcgcccatacagacatcatctgcagctaaatgtaagtgcccattttgctggctctattctgctatagcaggaaaagaaccaaatcacagtataagatgctcatacaaattgaagcccctcaatcaatgaaagttacagcttcttgacctaagattagtatcatattcatgtctcttctggtttcctctctgccaatgcatcttctgctttcattttctctggaacgaaatctagcacacaaccaaatgtcattgaataggtcatactgtcattggacatacaaacgatcaatacaaaaatttcatgatttaaccagatgtattaatatgggtatgaaaacaagtacctgaaagaaagtcatatctcttccacttgcaaacaagtgatgctgaaggagggggaaaaaaagacacacaagaaataatcagcataactaagaaaggttaatgcctaatctccatgcgtcaaacagccaaattcaccctacagcaactttcatcatttaagtgtcataagtacggtagcgctcaaatatgttaaatcacaacaaagatggtcaaaaataaaacttcagtaaggcatcaagttcacccaagcaagtgcaccaaatgataacttcgcatagttattccacactggcatgtattttgc

SEQ ID NO: 759 - DNA, 10412 bp, Artificial Sequence
  Description of Artificial Sequence: Synthetic DNA construct
ggccgcatttaaatgggccctcgagagcccgggctcctgcaggtaccttaattaaaagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttccccagatccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggcagtccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgatagacaactgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggtttttcttttcaccagtgagacgggcaacagctgattgcccttcaccgcctggccctgagagagttgcagcaagcggtccacgctggtttgccccagcaggcgaaaatcctgtttgatggtggttccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccacggccgctctagaactagtggatcccccctacgtgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatccctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctggagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatctgttaatcagaaaaactcagattaatcgacaaattcgatcgcacaaactagaaactaacaccagatctagatagaaatcacaaatcgaagagtaattattcgacaaaactcaaattatttgaacaaatcggatgatatttatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaaggatatcctgatccgttgacggcgcgccaagcggccgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcacggataacagagtctttatattaaacgaaatggtattgcagtgccggccaggacaccagtattggcttcaactgaccgacgaaaagaaaaatataacataagagggtctgaaacagacaaacaacactaacacatacataaacacaatttattcgtgagaaatacgacaaacactgaacatcacccgaatttattatccacaaataacacccatcgataagcttccagatttctggtggagctccagacaactgctggacgaattgatcgatgagtaaggactcaaatcttcttcaaaaattcgatgatccatgtattgtaagcgcagcaggctactcggaaaccttcaaatccagcccccttggccaaggcctcaaactccttctcagttctctctttcccacctgggttatgagccaacatgatgacatcaatatggaccactgccttagtggggaggcttgcgtctggcgccacgggaagaatgcattcagcaaggatcaccttcccattggttggaagtgctccataacatttcttcaaaaatttcaagcagtgttcatcgctccaatcatgacatatccacttcatgaaaatggcatctccttttggaacactaacaaacatatctccaccaacatgctccacaccaggataggagggagcctcctcaataacatgaggcaagtcgaagttaatgcccttgatcatggggtatttagcgataatcatgttaagggtggcaccagtgccaccaccaacatcaaccacagatccaagtccctcgaaccctttgtaagtctcaaggattttcttcatggtaatggtcgaatgattggacattccattgttgaaaactgtgttgaatctgggatcggtgccatggtactcaaatgctgtcattccataggccttgttaaatggaattccaccttcaagaactgcctcggtcaagtggtaccagctctccatgaggaccttgtcttgattcatgagagacagagcggctatggagactccatcatcgtttctggtcaagaatttacaaacgggtgcaaggccgtaaagcctctcgatcttgccgtcagggagggtgcggagagagcacgttagaacagagtagctagccaagaggcggagcatacggtcaagcatgacggctgcatctggattctttgtgggcagcttagaggctatgtcagatgtggatatgtgcgcacctggaccagctttagccatgatttctaagacgtcgagctctatggctgattttaggaccatgggaagaactgaagcactggttaattgcatagcgaatacgaatgcttcttcttctgctgctgctgcttcactcgggctcatcttcgtttcgcttgttgatcccatgatcgatcaattcctgcagcccgggggatccggcgatcgaaatactgaaaataaaaacctttcaattgattcaatcccaatccgaacctgatcaaattctccgcagaaacaggcgaaaaatggcggaaaacgtgtctgacaaatgtagcctgcagtgggaagaattgaatgagctgggggctactgagaaggaagcagaggccggctttttatattggattttcctgtgcagtacattgtatagaaagccggcctggaattgttggtgaagagtcaagtggcgtatggttgaataatgggcaaccacggcaggcgatcgagtgagtgggtggagggtcccgtggccaccaactctgcgatgtgaaggagcggttggatttttgacggagattatgactttttccattgacgtctacgttactacctaccccgaaaactccattcggacaactcgccggtaatacgccgtctacctacccccatcccggctaggccaacacccgcgctctctcgcccaccgcttgtttgaccgatcacccagacatttcattcgctgttttcggaccgcatttgtcagtcagttcacaccaggtggaaattagaattggttagattacaataagaaaaatgccttagccaatagcatgggatacaaatctgaaatcccattaaattggtgtttaaaatgtgtttttattatataatggatttagtatcttcaaaaaccgaagatacttggattactgaaagtttataactcaaccttcattccaataaatcccagagcaaatatgtctggaaaatctctaaaatgtataaaaaaatatattattgggtaaaaaaattctcaatttccaaaaatatggagttcgaactatattttgggagattgagagaaatatttgggattttttttgtctaatttccaatccacaaatgacatgatgagctttaatgtaatgattttgaaatttgtttggaaattaatagtccctagacgagaacattctatatttctcttatacaatataatttccaatccacaaatgacatgatgagctttaatgtaatgattttgaaacttgtttggagattaatagtccctggacgagaacattctatatttcttggatacaatataaagatattttctatgtaaaaaaattaaaaaataagaattaattaatgagatcttaattacgggccatgaggttttttattttattggaaactggttattgtctttcttgaaatcataatgttgataatgttttgtaatttaaattttatttgagatttttggtttttatacaaattggttaatctattccatgaagttttattatttaaattgtattttgaatgcaaaatagatttaatattttggaaaatatttggaatatttgacttcaaaagtttattaatttaaaattaattttttctaaattttaacttaaatataagataaaatttaccaacaaattttttaaaaataatagtgtttaattattttagattttgaaatttttactctaaatttaacaaaacaattttttatccaattataatttttgttattcaaaataaaattttaattacatatataaatttaacatcttaaaaaatccataaaacactcattcacaactcaatttatagttcttaccaaccttttccaaattttaagtaaactcaacccaaaaatatatatatatatatatatttttaaaaactccataacatatcacaaataaattactaaaaaaatcccaaaatcacttattaaaacacccttattccataaaataaaagatacgttaattggattcgaactataaaactaatgagttaatgagacgacaaactcattcttaaaaggtagagtttcaagtttgtttatgttttcaaaatttttgtgatcagcgtccttttaaatgtactcacattttcagtgtttagctttattttaaagttttgatgaattttgtataaaaagtttgtttattttgaagttttaataaattttgtataatatttttttttaaatagttaagtttatttatttattaatctattttaattttgttggaggaggttgtgattgaagaagttgtgattaaagtgtattgttgaaagaaattctttatattaagggtttaagtttgaattttgtgaacacaattataattatgttaaagatgaaaattttgttttcttttatttttgtaaatccttcttgttttgagatgaatttatgaataaatgtcaccacccggccgc

SEQ ID NO: 760 - DNA, 19223 bp, Artificial Sequence
  Description of Artificial Sequence: Synthetic DNA construct
cttaattaaaagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttccccagatccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggcagtccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgatagacaactgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggtttttcttttcaccagtgagacgggcaacagctgattgcccttcaccgcctggccctgagagagttgcagcaagcggtccacgctggtttgccccagcaggcgaaaatcctgtttgatggtggttccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccacggccgctctagaactagtggatcccccctacgtgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatccctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctggagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatctgttaatcagaaaaactcagattaatcgacaaattcgatcgcacaaactagaaactaacaccagatctagatagaaatcacaaatcgaagagtaattattcgacaaaactcaaattatttgaacaaatcggatgatatttatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaaggatatcctgatccgttgacggcgcgccaagcggccgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcacggataacagagtctttatattaaacgaaatggtattgcagtgccggccaggacaccagtattggcttcaactgaccgacgaaaagaaaaatataacataagagggtctgaaacagacaaacaacactaacacatacataaacacaatttattcgtgagaaatacgacaaacactgaacatcacccgaatttattatccacaaataacacccatcgctagaagtactctcgagttttttttttttttttttttttttgacgaagaaagcgtatcagtatcttggaactgcgctagcaagcggggtgtagaaccaaaatgtgcatcttccacacactccaaagttcaaaacaggaacgttctcacttactaatggattcttactgcagagaattacacacatacggaccatcatgcatgttcgatgatgttcaatgcacctgccaaactataatcttcctgaatatgcttcaagatctgtgacaaacaaactgagccagacaatcggccttaatctcccagccaaatttttatttggacaccaaaatttttacttgacaccatcataggcaatctaatcagagtctctggagcctcatgcttcttttaaggtgttgccaatatctatcacaaaccggtacttgacatcgcccttggcaaggcggtccattgctgtgttcacatagtcgatagaaatgacctcaatatcggcggtaatcttgtgctttgctgcaaaatcaatcatctcttgagtttcttgtattccaccaatgcaactcccagccacaatcttcctcccaaagatcaatgggaaaacgggtaactcgagaggccgatcaggagctccaacgagaacaagctttccgttctgtttgagcaaaccaatcaaaggcaatatcgggtgcacagccgaaaccgtgtcgattataccatccattgtgcccattgcagcctgaacttgattggtgtcgctgctaataaggaatgcatcggcgccgagacgctggagcgcttcctccctcttcccgggagaggagctgatcacggtcaccttgacccccatcgccttcgcaaattttactgcaacatggcccagtccaccgagacccaccaggcccaagtggatccctgggtggtcgagcccaaagaacttcattgggctataaacagtgatcccggcacaaagcaaaggagcgccggcatcgagaggcatgttttgcgggaatttgatggcgaagtgctcatccaccaccatcatgttggagtatcctccgtgggtcatcgtcccatcatggtacatggcaccataagtcagaatcattttggggcagtaattctcgagttggtcgtggcaactatcgcaggagccgcacgatccgaccaggcaacccactcccactttgtctcccgccttgaacttctccaccttgctcccaacctcaacaacttcgcccacaatctcgtgcccgggaacaagaggataagtcgagaatccccactcgttcctcacgctgtggaggtcgctgtggcagattccgcagaaaaacaccttgaacttcacgtctttctctcccgttgtcctgcgggagaatttgaagggagacaggaggccggaggggtctctcgcagcccagccgaaagccgcctgcgggtgctcttgctccggcgacttcgccattttttccccgatgcaatggaaggattttctcttcttcttgttttctcgtgactcgtgccgaattcgataagcttccagatttctggtggagctccagacaactgctggacgaattcctgcagcccgggggatctggacagtgaagaagtggtacttgaagaaggcttttggttgtgtgaggaaagaggagggagagagtggcaatttatttgaaatctgggaaagagagtggtgctcatcaaagtgggagaaaatgaaattaggtgagaggttccaatttttagttaggggaattcagtagttagcacctcaatgataagtgttgtgcgaaaagcaaaaacatggatggaataaatggagagagagagagagagagagagagccgggggatcattcactgttacagcaactagtttgcttgagaaagcaggaaaaatggtagagggagatcaaatggacatggcacaaatcaggccatgcgtgattgcttgggtttcactttgtatttatttctggtacaaaatcaatttgcctgccaacaaacttaggaggaaagcttttgcagcttccttatcttttgcgagggagatgaatcgagattcatgtttgctgcagaaaatagggcccaacactctcatcaacttgattaggattgagttgacttctgcatagcaactttggttgtgcgaatttccctttcctttttttcccgagtaccttgttattcattattgaaaggtgaaacataaagtggggtaatccagacttgcaagcaccaaacagccaatggttttagatatttgcatttgtcagctgtgattgaaaagaaagaaaaggcatctgttaccaatcaaacattcgacctaaggattaagacttgccagtgccatccatccgctctgtaaggcatcgctggatccatattaaagaggaaacagacatttcacctcacccccatcaatccttgttaggttctctagatgtctagttacaaacaaggtgattgcctctgcggaacatacatgagaaatatcatccacttgaaaaactgacatcttcgccactttagttcgaatggactaactaaaatcccaaccatttaggatttgttataatcttctcctcaatgattgaaatgtaagttctttccatgtttgcagcagagagcagactcttttatgctattgaaaatgatctttctcgcacgaactgttcgctacacttgaacccccttcatgtcgtgctgtacattaaaagaatgcattcgaagacttgttacagcggttctctacagttctgcgtcactgccgatggcttgtataagacaccttttgccacggcggcccaacagctaatcttcaacacctatcgtctggttaatttgatattactcattacacacacccacacacacagagtgcgataacataaatgacagtcatcagtaagattcataatcaatcatctcagcatgatctgtccatcactataacaacatttgcctttccatttctgatggctggcgaacacgcgatggtttaatcatctttgattataacctgcttcctaagctaaaaaaaaccagagcttacagcagtgactgtgtgaatccagttcgtagggatctggatatccattcttaaaaactatattgccaagatgcaactctcctcattagactccccgggttttcgtgaatagattgacatagattgatctgaatatctttagtataacgcaaaacagatataacataggccgagaatcagattaactacaaagtacttgtccatgacagattaattacaaaacacctaactccccagaagaagctatcccaccatccatgttagcagggcatgagactatttgctgaaaaaattaccagaagtataagcatttctcttctccaatgtaacatgcgaaaaaattcgcccatacagacatcatctgcagctaaatgtaagtgcccattttgctggctctattctgctatagcaggaaaagaaccaaatcacagtataagatgctcatacaaattgaagcccctcaatcaatgaaagttacagcttcttgacctaagattagtatcatattcatgtctcttctggtttcctctctgccaatgcatcttctgctttcattttctctggaacgaaatctagcacacaaccaaatgtcattgaataggtcatactgtcattggacatacaaacgatcaatacaaaaatttcatgatttaaccagatgtattaatatgggtatgaaaacaagtacctgaaagaaagtcatatctcttccacttgcaaacaagtgatgctgaaggagggggaaaaaaagacacacaagaaataatcagcataactaagaaaggttaatgcctaatctccatgcgtcaaacagccaaattcaccctacagcaactttcatcatttaagtgtcataagtacggtagcgctcaaatatgttaaatcacaacaaagatggtcaaaaataaaacttcagtaaggcatcaagttcacccaagcaagtgcaccaaatgataacttcgcatagttattccacactggcatgtattttgcggccgcatttaaatgggccctcgagagcccatcctgatccgttgacggcgcgccaagcggccgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcacggataacagagtctttatattaaacgaaatggtattgcagtgccggccaggacaccagtattggcttcaactgaccgacgaaaagaaaaatataacataagagggtctgaaacagacaaacaacactaacacatacataaacacaatttattcgtgagaaatacgacaaacactgaacatcacccgaatttattatccacaaataacacccatcgataagcttccagatttctggtggagctccagacaactgctggacgaattgatcgatgagtaaggactcaaatcttcttcaaaaattcgatgatccatgtattgtaagcgcagcaggctactcggaaaccttcaaatccagcccccttggccaaggcctcaaactccttctcagttctctctttcccacctgggttatgagccaacatgatgacatcaatatggaccactgccttagtggggaggcttgcgtctggcgccacgggaagaatgcattcagcaaggatcaccttcccattggttggaagtgctccataacatttcttcaaaaatttcaagcagtgttcatcgctccaatcatgacatatccacttcatgaaaatggcatctccttttggaacactaacaaacatatctccaccaacatgctccacaccaggataggagggagcctcctcaataacatgaggcaagtcgaagttaatgcccttgatcatggggtatttagcgataatcatgttaagggtggcaccagtgccaccaccaacatcaaccacagatccaagtccctcgaaccctttgtaagtctcaaggattttcttcatggtaatggtcgaatgattggacattccattgttgaaaactgtgttgaatctgggatcggtgccatggtactcaaatgctgtcattccataggccttgttaaatggaattccaccttcaagaactgcctcggtcaagtggtaccagctctccatgaggaccttgtcttgattcatgagagacagagcggctatggagactccatcatcgtttctggtcaagaatttacaaacgggtgcaaggccgtaaagcctctcgatcttgccgtcagggagggtgcggagagagcacgttagaacagagtagctagccaagaggcggagcatacggtcaagcatgacggctgcatctggattctttgtgggcagcttagaggctatgtcagatgtggatatgtgcgcacctggaccagctttagccatgatttctaagacgtcgagctctatggctgattttaggaccatgggaagaactgaagcactggttaattgcatagcgaatacgaatgcttcttcttctgctgctgctgcttcactcgggctcatcttcgtttcgcttgttgatcccatgatcgatcaattcctgcagcccgggggatccggcgatcgaaatactgaaaataaaaacctttcaattgattcaatcccaatccgaacctgatcaaattctccgcagaaacaggcgaaaaatggcggaaaacgtgtctgacaaatgtagcctgcagtgggaagaattgaatgagctgggggctactgagaaggaagcagaggccggctttttatattggattttcctgtgcagtacattgtatagaaagccggcctggaattgttggtgaagagtcaagtggcgtatggttgaataatgggcaaccacggcaggcgatcgagtgagtgggtggagggtcccgtggccaccaactctgcgatgtgaaggagcggttggatttttgacggagattatgactttttccattgacgtctacgttactacctaccccgaaaactccattcggacaactcgccggtaatacgccgtctacctacccccatcccggctaggccaacacccgcgctctctcgcccaccgcttgtttgaccgatcacccagacatttcattcgctgttttcggaccgcatttgtcagtcagttcacaccaggtggaaattagaattggttagattacaataagaaaaatgccttagccaatagcatgggatacaaatctgaaatcccattaaattggtgtttaaaatgtgtttttattatataatggatttagtatcttcaaaaaccgaagatacttggattactgaaagtttataactcaaccttcattccaataaatcccagagcaaatatgtctggaaaatctctaaaatgtataaaaaaatatattattgggtaaaaaaattctcaatttccaaaaatatggagttcgaactatattttgggagattgagagaaatatttgggattttttttgtctaatttccaatccacaaatgacatgatgagctttaatgtaatgattttgaaatttgtttggaaattaatagtccctagacgagaacattctatatttctcttatacaatataatttccaatccacaaatgacatgatgagctttaatgtaatgattttgaaacttgtttggagattaatagtccctggacgagaacattctatatttcttggatacaatataaagatattttctatgtaaaaaaattaaaaaataagaattaattaatgagatcttaattacgggccatgaggttttttattttattggaaactggttattgtctttcttgaaatcataatgttgataatgttttgtaatttaaattttatttgagatttttggtttttatacaaattggttaatctattccatgaagttttattatttaaattgtattttgaatgcaaaatagatttaatattttggaaaatatttggaatatttgacttcaaaagtttattaatttaaaattaattttttctaaattttaacttaaatataagataaaatttaccaacaaattttttaaaaataatagtgtttaattattttagattttgaaatttttactctaaatttaacaaaacaattttttatccaattataatttttgttattcaaaataaaattttaattacatatataaatttaacatcttaaaaaatccataaaacactcattcacaactcaatttatagttcttaccaaccttttccaaattttaagtaaactcaacccaaaaatatatatatatatatatatttttaaaaactccataacatatcacaaataaattactaaaaaaatcccaaaatcacttattaaaacacccttattccataaaataaaagatacgttaattggattcgaactataaaactaatgagttaatgagacgacaaactcattcttaaaaggtagagtttcaagtttgtttatgttttcaaaatttttgtgatcagcgtccttttaaatgtactcacattttcagtgtttagctttattttaaagttttgatgaattttgtataaaaagtttgtttattttgaagttttaataaattttgtataatatttttttttaaatagttaagtttatttatttattaatctattttaattttgttggaggaggttgtgattgaagaagttgtgattaaagtgtattgttgaaagaaattctttatattaagggtttaagtttgaattttgtgaacacaattataattatgttaaagatgaaaattttgttttcttttatttttgtaaatccttcttgttttgagatgaatttatgaataaatgtcaccacccggccgcggccgcatttaaatgggccctcgagagcccgggctcctgcaggtaccatttaaatgcggccgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcacggataacagagtctttatattaaacgaaatggtattgcagtgccggccaggacaccagtattggcttcaactgaccgacgaaaagaaaaatataacataagagggtctgaaacagacaaacaacactaacacatacataaacacaatttattcgtgagaaatacgacaaacactgaacatcacccgaatttattatccacaaataacacccatcgataagcttccagatttctggtggagctccagacaactgctggacgaattcctgcagatcgatcaatcattcgatcaatagagaggacagagaaggcgtggactcggcacggcggtgagtcgaatcgctcttggcgcggtgagtccaaacacatcattcatctcgagttcactcggtttcatcccgtccggcaactcccacgtgaaacagtgaaggaggtgagccacagtcgtctctagcgcgtagagtccgagttgcataccggggcaagaccgacgacctgacccgaatgggatgaactcgaagttgttccctttgaaatcgggcacaccgtctttgagaaacctggagggcctaaacgtatctgggtcggcccacgagttcttgtcccggccgatggcgcacgcgttgatcatcacccgcgatttcgccggaatgtagtagccgccgacctcggcgtcctcggcagtctcgtggaggaggagtgggatgggtgggtggaggcgaaggacttccttcagtacgcatttcaagtaggtgagcttctcgaagtctttctcttcgactcgccggtcaagacccaccaccacggcgagttcttgttggaccttctttagatcttctgggcttttcatcagctccgtcatggcccattcaatcgcggacgccaccgtttcggtccctccaaacattacgtccatgatagctttgatgttgtctttggtgagtttgatggaattttgaagatcgtcagattcgcttactttggcttcctcaccgtaaaaagcaagtaaatcatctaccatatcagtatcaacctcctccgagtttttactccccttctgtatatgatcgtcgatgatcttgtcaataaacccatcaagcgcccctcgtgccttgttgagcctgacgttaatcccctgaggaacccatttgagccaagggataaaatcagctatattaaaagcaccaaacagctgcgaaaactcttgcagtatggccacgaactcgtcctggtcctcatgcgagatcgtcccaaaagccgccctgtaagtaatattcttcgtcagagcaaaaaccagctcgccgatattcaccgtcgacccaatattggacgcgaccactcgtactgccgagtcgacctcgtctcggaccgactcccacgactcggctcgtttccggctaaataatttcatgacgcagagtttacgcatctgacgccaaaacgggccgtagtgagcgaaggccatgtcggctcggtcataggtgaggtagctgatggctatggtggctggccggttcgagaagatgttgtcttggacttgaaggacttggcgagccatgtcgggtgtggaaacggccaccatgtgtaagaatcccatcttgaggtggaatagaccgccgtattgtttggcgagtttggcgagtcctcggtgagtgagttgatccatcatgagcatgtttccgatcaccggtaagccttttgggcctggtgggtatggtagtctctggcgaagccgagatactaggcccaataagagtagcaaaggtataatgaagaacagcgtcatgggtagtggttgcaaggcttcatgaagagaagaatccatggcctgcagcccgggggatcgcttgaaattgaaatatgactaacgaatatacctgcacatcatcacaagctaattagacagatacttcaaggaataaataattcatcacccaaatacagaccaacggacagattctgcgaaagaagcacaaaagaagagggcagacaccctagcaacccatagttacaacctgaacacaaatattaacaagaaatcaaaaagaaagagacaccctaaaatacagttgcaatagaaataaaatatggcaccagcaatccacgaattagaaaaagaaccatcagttcgaaggataagaggaagaaaatatgtgacatgtgacatgtcaatagtaacgcacaaaccctaacagcttacacatagaggaccttatagggaaagcacatcactgtgaataatcacctaccctcagaacccgggcccaaaattaaaatattactacagaacgccacaagaaaatgctcaaagaagaaagggttcctgtgagatcaaaggagggaaactataacaaggttggagacaaaatattaaagtacaacgcaataatctgcaaaggccttctgaaacacatgacgcaataaaacgcaaacacctgctgaaacctttacagacaagagcctattacaaacagcgactactcataacttacatacgaaaattaaatattccagagagacagacctattaagggaagaaaacacagatgaaagcacgaaagccctagtaatgtcagccatagtcgagaaaaataacccaaataaacatgcgaaacccaaaaggacctggcaaaagattcttcccccacagaaaccaccattaacaatttacaaagaaaaacaaatgttaagagtaaagcccttcaaaactccatacctttgaatgaaaagctctctgagaatatcgcactgattatacaacgcaagagaaaagatgagaagtaacgcggtgaaggcgagtatttaatagcgttggatgagacccttctcccgctacgcgacacgacaacagacgacctgtcaccatcggtggttgcgtaccagcggggataacaacgacattttccaatagagaaatgacacgtgtatactgtgcgctggctgtgtcggtgggttatacagggtcatccggtcgcacatccgtcacgcttctcgagacgtatgtaaagcgcgtctgtaggattccaactccgcgtggaccccacaataaattactttttaatacaaaaccagggagataaaagattctcgttcgagggatctccgatatgtcattatgccatttaagtaaaataaataaactttttgtttttttaagtaaataaaagaaataaattgttggtttgtgaatacttttatttactttatttctttatctactcttaaggaatgtaattaacggtgaagtaggaaaagttttacggttaggggaggagttgctttgaaagttatgaaaattctagttatatttagagaaaatccgatacggatttttgtagatccaagttatttttgttaaacttcaaaattttaggtgtcctgaatgtttttgatggtgctgaatctatttccatcataaaaaacatgattcaagcactccctctacaaaaaaattttaatcttttttaccgggattccggccacttttaactgtctagggaattcctccgcctcctggttagacgattccaatgtcttatcctctcaaacttgtacatcaatatttgttcactttggttttctttttgacttaataatacatagattttttactctataatccttggattttcttgaaagtaagtttggtagatggatttttccattgataaatcttgttgacttggtgaacatctttccaactatgggcaatttgtccaagtggatcttctagactcctttgagtggatatatttatacaattttgatatgatttaggaagtaatgtagtttttttatatcaatgtagttagttttttccaacattcaggattgtaacggttggtgggaaaggtagtggagagtttgataattaaataaagaattttttttatgtatttgtgaggggttttgcggccgcatttaaatggtac

SEQ ID NO: 761 - DNA, 9574 bp, Artificial Sequence
  Description of Artificial Sequence: Synthetic DNA construct
cgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggcagtccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgatagacaactgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggtttttcttttcaccagtgagacgggcaacagctgattgcccttcaccgcctggccctgagagagttgcagcaagcggtccacgctggtttgccccagcaggcgaaaatcctgtttgatggtggttccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccacggccgctctagaactagtggatcccccctacgtgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatccctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctggagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatctgttaatcagaaaaactcagattaatcgacaaattcgatcgcacaaactagaaactaacaccagatctagatagaaatcacaaatcgaagagtaattattcgacaaaactcaaattatttgaacaaatcggatgatatttatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaaggatatcctgatccgttgacggcgcgccaagcggccgcatttaaatgggcccactggatttggttttaggaattagaaattttattgatagaagtattttacaaatacaaatacatactaagggtttcttatatgctcaacacatgagcgaaaccctataagaaccctaattcccttatctgggaactactcacacattattctggagaaaaatagagagagatagatttgtagagagagactggtgatttttgcgccgggtaccgagctcggtagcaattcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacctgcacatcaacaaattttggtcatatattagaaaagttataaattaaaatatacacacttataaactacagaaaagcaattgctatatactacattcttttattttgaaaaaaatatttgaaatattatattactactaattaatgataattattatatatatatcaaaggtagaagcagaaacttacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgaccaattccacagttttcgcgatccagactgaatgcccacaggccgtcgagttttttgatttcacgggttggggtttctactggatccatggccatctgttaatcagaaaaaccgagattaatcgacaaattcgatcgcacaaacaagaaactaacaccaaatctagataaaaatcacagatcaaagcgtaaataatcgagaacacacaaattctttcaacaaatcggatcaaatacaaggaaacaacaagaaaataaacagatctgcgaaaaatacgaaccctaatcgagaaataagaagagatctaacgatgaaactatgtaatttgcctccgatcagagattaacgagatcaaaatcaaagaacagagcctaaattgcgatcgaacgaaacaaatcgaagaaatacaataagaactcagaaatctaccttgatcacggttgagagatttgagagattgattttagagtttgagaaaattggaatctgaattgtgaagaagaagagctctttgggtatttgatttatagaagcaaaaaagacgaggacgactcggtcggtcacgagaaagctaaggcgtggaagcaatagccaattataaattgacacgtatgtgtagggacgtgtacgcgttgttcacacgcaaagttgtttttggctaattgccttatttttaggttgaggaaaagtattttgtgcattgagttgttaaaaatttgatgtaaagatagtttgctgcgagacatatactgaaagttgaattaccattagatgagatcattagataatctggataagtatgccaagaagttctctgagttgaaatttgaattaagcacaactgagagacatatactgaaagagatgggttttgtttgtcatgttgaacactagaaacacctccggaattgaggcaagaagctcgagagcccgggctcctgcaggtaccttaattaaaagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttccccagatc

SEQ ID NO: 762 - DNA, 15856 bp, Artificial Sequence
  Description of Artificial Sequence: Synthetic DNA construct
tcgacatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgattttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgtacggaatgccagcactcccgaggggaaccctgtggttggcatgcacatacaaatggacgaacggataaaccttttcacgcccttttaaatatccgttattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatccaacgcgttgggagctctcccatatcgacctgcaggcggccgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcacggataacagagtctttatattaaacgaaatggtattgcagtgccggccaggacaccagtattggcttcaactgaccgacgaaaagaaaaatataacataagagggtctgaaacagacaaacaacactaacacatacataaacacaatttattcgtgagaaatacgacaaacactgaacatcacccgaatttattatccacaaataacacccatcgataagcttccagatttctggtggagctccagacaactgctggacgaattcctgcagatcgatcaatcattcgatcaatagagaggacagagaaggcgtggactcggcacggcggtgagtcgaatcgctcttggcgcggtgagtccaaacacatcattcatctcgagttcactcggtttcatcccgtccggcaactcccacgtgaaacagtgaaggaggtgagccacagtcgtctctagcgcgtagagtccgagttgcataccggggcaagaccgacgacctgacccgaatgggatgaactcgaagttgttccctttgaaatcgggcacaccgtctttgagaaacctggagggcctaaacgtatctgggtcggcccacgagttcttgtcccggccgatggcgcacgcgttgatcatcacccgcgatttcgccggaatgtagtagccgccgacctcggcgtcctcggcagtctcgtggaggaggagtgggatgggtgggtggaggcgaaggacttccttcagtacgcatttcaagtaggtgagcttctcgaagtctttctcttcgactcgccggtcaagacccaccaccacggcgagttcttgttggaccttctttagatcttctgggcttttcatcagctccgtcatggcccattcaatcgcggacgccaccgtttcggtccctccaaacattacgtccatgatagctttgatgttgtctttggtgagtttgatggaattttgaagatcgtcagattcgcttactttggcttcctcaccgtaaaaagcaagtaaatcatctaccatatcagtatcaacctcctccgagtttttactccccttctgtatatgatcgtcgatgatcttgtcaataaacccatcaagcgcccctcgtgccttgttgagcctgacgttaatcccctgaggaacccatttgagccaagggataaaatcagctatattaaaagcaccaaacagctgcgaaaactcttgcagtatggccacgaactcgtcctggtcctcatgcgagatcgtcccaaaagccgccctgtaagtaatattcttcgtcagagcaaaaaccagctcgccgatattcaccgtcgacccaatattggacgcgaccactcgtactgccgagtcgacctcgtctcggaccgactcccacgactcggctcgtttccggctaaataatttcatgacgcagagtttacgcatctgacgccaaaacgggccgtagtgagcgaaggccatgtcggctcggtcataggtgaggtagctgatggctatggtggctggccggttcgagaagatgttgtcttggacttgaaggacttggcgagccatgtcgggtgtggaaacggccaccatgtgtaagaatcccatcttgaggtggaatagaccgccgtattgtttggcgagtttggcgagtcctcggtgagtgagttgatccatcatgagcatgtttccgatcaccggtaagccttttgggcctggtgggtatggtagtctctggcgaagccgagatactaggcccaataagagtagcaaaggtataatgaagaacagcgtcatgggtagtggttgcaaggcttcatgaagagaagaatccatggcctgcagcccgggggatcgcttgaaattgaaatatgactaacgaatatacctgcacatcatcacaagctaattagacagatacttcaaggaataaataattcatcacccaaatacagaccaacggacagattctgcgaaagaagcacaaaagaagagggcagacaccctagcaacccatagttacaacctgaacacaaatattaacaagaaatcaaaaagaaagagacaccctaaaatacagttgcaatagaaataaaatatggcaccagcaatccacgaattagaaaaagaaccatcagttcgaaggataagaggaagaaaatatgtgacatgtgacatgtcaatagtaacgcacaaaccctaacagcttacacatagaggaccttatagggaaagcacatcactgtgaataatcacctaccctcagaacccgggcccaaaattaaaatattactacagaacgccacaagaaaatgctcaaagaagaaagggttcctgtgagatcaaaggagggaaactataacaaggttggagacaaaatattaaagtacaacgcaataatctgcaaaggccttctgaaacacatgacgcaataaaacgcaaacacctgctgaaacctttacagacaagagcctattacaaacagcgactactcataacttacatacgaaaattaaatattccagagagacagacctattaagggaagaaaacacagatgaaagcacgaaagccctagtaatgtcagccatagtcgagaaaaataacccaaataaacatgcgaaacccaaaaggacctggcaaaagattcttcccccacagaaaccaccattaacaatttacaaagaaaaacaaatgttaagagtaaagcccttcaaaactccatacctttgaatgaaaagctctctgagaatatcgcactgattatacaacgcaagagaaaagatgagaagtaacgcggtgaaggcgagtatttaatagcgttggatgagacccttctcccgctacgcgacacgacaacagacgacctgtcaccatcggtggttgcgtaccagcggggataacaacgacattttccaatagagaaatgacacgtgtatactgtgcgctggctgtgtcggtgggttatacagggtcatccggtcgcacatccgtcacgcttctcgagacgtatgtaaagcgcgtctgtaggattccaactccgcgtggaccccacaataaattactttttaatacaaaaccagggagataaaagattctcgttcgagggatctccgatatgtcattatgccatttaagtaaaataaataaactttttgtttttttaagtaaataaaagaaataaattgttggtttgtgaatacttttatttactttatttctttatctactcttaaggaatgtaattaacggtgaagtaggaaaagttttacggttaggggaggagttgctttgaaagttatgaaaattctagttatatttagagaaaatccgatacggatttttgtagatccaagttatttttgttaaacttcaaaattttaggtgtcctgaatgtttttgatggtgctgaatctatttccatcataaaaaacatgattcaagcactccctctacaaaaaaattttaatcttttttaccgggattccggccacttttaactgtctagggaattcctccgcctcctggttagacgattccaatgtcttatcctctcaaacttgtacatcaatatttgttcactttggttttctttttgacttaataatacatagattttttactctataatccttggattttcttgaaagtaagtttggtagatggatttttccattgataaatcttgttgacttggtgaacatctttccaactatgggcaatttgtccaagtggatcttctagactcctttgagtggatatatttatacaattttgatatgatttaggaagtaatgtagtttttttatatcaatgtagttagttttttccaacattcaggattgtaacggttggtgggaaaggtagtggagagtttgataattaaataaagaattttttttatgtatttgtgaggggttttgcggccgcactagtgatatcccgcggccatggcggccgggagcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaaacgttaatgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaatggcaattaccttatccgcaacttctttacctatttccgcccggatccgggcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaattaattccaggcggtgaagggcaatcagctgttgcccgtctcactggtgaaaagaaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatgtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattacccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagccgggatggcgctaagaagctattgccgccgatcttcatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaaacaagtggcagcaacggattcgcaaacctgtcacgccttttgtgccaaaagccgcgccaggtttgcgatccgctgtgccaggcgttaggcgtcatatgaagatttcggtgatccctgagcaggtggcggaaacattggatgctgagaaccatttcattgttcgtgaagtgttcgatgtgcacctatccgaccaaggctttgaactatctaccagaagtgtgagcccctaccggaaggattacatctcggatgatgactctgatgaagactctgcttgctatggcgcattcatcgaccaagagcttgtcgggaagattgaactcaactcaacatggaacgatctagcctctatcgaacacattgttgtgtcgcacacgcaccgaggcaaaggagtcgcgcacagtctcatcgaatttgcgaaaaagtgggcactaagcagacagctccttggcatacgattagagacacaaacgaacaatgtacctgcctgcaatttgtacgcaaaatgtggctttactctcggcggcattgacctgttcacgtataaaactagacctcaagtctcgaacgaaacagcgatgtactggtactggttctcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtacttgcgatggcatcggggcaggcacttgctgacctgccaattgttttagtggatgaagctcgtcttccctatgactactccccatccaactacgacatttctccaagcaactacgacaactccataagcaattacgacaatagtccatcaaattacgacaactctgagagcaactacgataatagttcatccaattacgacaatagtcgcaacggaaatcgtaggcttatatatagcgcaaatgggtctcgcactttcgccggctactacgtcattgccaacaatgggacaacgaacttcttttccacatctggcaaaaggatgttctacaccccaaaaggggggcgcggcgtctatggcggcaaagatgggagcttctgcggggcattggtcgtcataaatggccaattttcgcttgccctgacagataacggcctgaagatcatgtatctaagcaactagcctgctctctaataaaatgttaggagcttggctgccatttttggggtgaggccgttcgcggccgaggggcgcagcccctggggggatgggaggcccgcgttagcgggccgggagggttcgagaagggggggcaccccccttcggcgtgcgcggtcacgcgccagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaaggg

SEQ ID NO: 763 - DNA, 16280 bp, Artificial Sequence
  Description of Artificial Sequence: Synthetic DNA construct
tcgacatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgattttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgtacggaatgccagcactcccgaggggaaccctgtggttggcatgcacatacaaatggacgaacggataaaccttttcacgcccttttaaatatccgttattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatccaacgcgttgggagctctcccatatcgacctgcaggcggccgcaaaatacatgccagtgtggaataactatgcgaagttatcatttggtgcacttgcttgggtgaacttgatgccttactgaagttttatttttgaccatctttgttgtgatttaacatatttgagcgctaccgtacttatgacacttaaatgatgaaagttgctgtagggtgaatttggctgtttgacgcatggagattaggcattaacctttcttagttatgctgattatttcttgtgtgtctttttttccccctccttcagcatcacttgtttgcaagtggaagagatatgactttctttcaggtacttgttttcatacccatattaatacatctggttaaatcatgaaatttttgtattgatcgtttgtatgtccaatgacagtatgacctattcaatgacatttggttgtgtgctagatttcgttccagagaaaatgaaagcagaagatgcattggcagagaggaaaccagaagagacatgaatatgatactaatcttaggtcaagaagctgtaactttcattgattgaggggcttcaatttgtatgagcatcttatactgtgatttggttcttttcctgctatagcagaatagagccagcaaaatgggcacttacatttagctgcagatgatgtctgtatgggcgaattttttcgcatgttacattggagaagagaaatgcttatacttctggtaattttttcagcaaatagtctcatgccctgctaacatggatggtgggatagcttcttctggggagttaggtgttttgtaattaatctgtcatggacaagtactttgtagttaatctgattctcggcctatgttatatctgttttgcgttatactaaagatattcagatcaatctatgtcaatctattcacgaaaacccggggagtctaatgaggagagttgcatcttggcaatatagtttttaagaatggatatccagatccctacgaactggattcacacagtcactgctgtaagctctggttttttttagcttaggaagcaggttataatcaaagatgattaaaccatcgcgtgttcgccagccatcagaaatggaaaggcaaatgttgttatagtgatggacagatcatgctgagatgattgattatgaatcttactgatgactgtcatttatgttatcgcactctgtgtgtgtgggtgtgtgtaatgagtaatatcaaattaaccagacgataggtgttgaagattagctgttgggccgccgtggcaaaaggtgtcttatacaagccatcggcagtgacgcagaactgtagagaaccgctgtaacaagtcttcgaatgcattcttttaatgtacagcacgacatgaagggggttcaagtgtagcgaacagttcgtgcgagaaagatcattttcaatagcataaaagagtctgctctctgctgcaaacatggaaagaacttacatttcaatcattgaggagaagattataacaaatcctaaatggttgggattttagttagtccattcgaactaaagtggcgaagatgtcagtttttcaagtggatgatatttctcatgtatgttccgcagaggcaatcaccttgtttgtaactagacatctagagaacctaacaaggattgatgggggtgaggtgaaatgtctgtttcctctttaatatggatccagcgatgccttacagagcggatggatggcactggcaagtcttaatccttaggtcgaatgtttgattggtaacagatgccttttctttcttttcaatcacagctgacaaatgcaaatatctaaaaccattggctgtttggtgcttgcaagtctggattaccccactttatgtttcacctttcaataatgaataacaaggtactcgggaaaaaaaggaaagggaaattcgcacaaccaaagttgctatgcagaagtcaactcaatcctaatcaagttgatgagagtgttgggccctattttctgcagcaaacatgaatctcgattcatctccctcgcaaaagataaggaagctgcaaaagctttcctcctaagtttgttggcaggcaaattgattttgtaccagaaataaatacaaagtgaaacccaagcaatcacgcatggcctgatttgtgccatgtccatttgatctccctctaccatttttcctgctttctcaagcaaactagttgctgtaacagtgaatgatcccccggctctctctctctctctctctctctccatttattccatccatgtttttgcttttcgcacaacacttatcattgaggtgctaactactgaattcccctaactaaaaattggaacctctcacctaatttcattttctcccactttgatgagcaccactctctttcccagatttcaaataaattgccactctctccctcctctttcctcacacaaccaaaagccttcttcaagtaccacttcttcactgtccagatcccccgggctgcaggaattcgtccagcagttgtctggagctccaccagaaatctggaagcttatcgaattcgattaaaatcgatctgcaggccatggattcttctcttcatgaagccttgcaaccactacccatgacgctgttcttcattatacctttgctactcttattgggcctagtatctcggcttcgccagagactaccatacccaccaggcccaaaaggcttaccggtgatcggaaacatgctcatgatggatcaactcactcaccgaggactcgccaaactcgccaaacaatacggcggtctattccacctcaagatgggattcttacacatggtggccgtttccacacccgacatggctcgccaagtccttcaagtccaagacaacatcttctcgaaccggccagccaccatagccatcagctacctcacctatgaccgagccgacatggccttcgctcactacggcccgttttggcgtcagatgcgtaaactctgcgtcatgaaattatttagccggaaacgagccgagtcgtgggagtcggtccgagacgaggtcgactcggcagtacgagtggtcgcgtccaatattgggtcgacggtgaatatcggcgagctggtttttgctctgacgaagaatattacttacagggcggcttttgggacgatctcgcatgaggaccaggacgagttcgtggccatactgcaagagttttcgcagctgtttggtgcttttaatatagctgattttatcccttggctcaaatgggttcctcaggggattaacgtcaggctcaacaaggcacgaggggcgcttgatgggtttattgacaagatcatcgacgatcatatacagaaggggagtaaaaactcggaggaggttgatactgatatggtagatgatttacttgctttttacggtgaggaagccaaagtaagcgaatctgacgatcttcaaaattccatcaaactcaccaaagacaacatcaaagctatcatggacgtaatgtttggagggaccgaaacggtggcgtccgcgattgaatgggccatgacggagctgatgaaaagcccagaagatctaaagaaggtccaacaagaactcgccgtggtggtgggtcttgaccggcgagtcgaagagaaagacttcgagaagctcacctacttgaaatgcgtactgaaggaagtccttcgcctccacccacccatcccactcctcctccacgagactgccgaggacgccgaggtcggcggctactacattccggcgaaatcgcgggtgatgatcaacgcgtgcgccatcggccgggacaagaactcgtgggccgacccagatacgtttaggccctccaggtttctcaaagacggtgtgcccgatttcaaagggaacaacttcgagttcatcccattcgggtcaggtcgtcggtcttgccccggtatgcaactcggactctacgcgctagagacgactgtggctcacctccttcactgtttcacgtgggagttgccggacgggatgaaaccgagtgaactcgagatgaatgatgtgtttggactcaccgcgccaagagcgattcgactcaccgccgtgccgagtccacgccttctctgtcctctctattgatcgaatgattgatcgatctgcagaaaatcactagtgaattcgatgggtgttatttgtggataataaattcgggtgatgttcagtgtttgtcgtatttctcacgaataaattgtgtttatgtatgtgttagtgttgtttgtctgtttcagaccctcttatgttatatttttcttttcgtcggtcagttgaagccaatactggtgtcctggccggcactgcaataccatttcgtttaatataaagactctgttatccgtgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgcggccgcactagtgatatcccgcggccatggcggccgggagcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaaacgttaatgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaatggcaattaccttatccgcaacttctttacctatttccgcccggatccgggcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaattaattccaggcggtgaagggcaatcagctgttgcccgtctcactggtgaaaagaaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatgtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattacccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagccgggatggcgctaagaagctattgccgccgatcttcatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaaacaagtggcagcaacggattcgcaaacctgtcacgccttttgtgccaaaagccgcgccaggtttgcgatccgctgtgccaggcgttaggcgtcatatgaagatttcggtgatccctgagcaggtggcggaaacattggatgctgagaaccatttcattgttcgtgaagtgttcgatgtgcacctatccgaccaaggctttgaactatctaccagaagtgtgagcccctaccggaaggattacatctcggatgatgactctgatgaagactctgcttgctatggcgcattcatcgaccaagagcttgtcgggaagattgaactcaactcaacatggaacgatctagcctctatcgaacacattgttgtgtcgcacacgcaccgaggcaaaggagtcgcgcacagtctcatcgaatttgcgaaaaagtgggcactaagcagacagctccttggcatacgattagagacacaaacgaacaatgtacctgcctgcaatttgtacgcaaaatgtggctttactctcggcggcattgacctgttcacgtataaaactagacctcaagtctcgaacgaaacagcgatgtactggtactggttctcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtacttgcgatggcatcggggcaggcacttgctgacctgccaattgttttagtggatgaagctcgtcttccctatgactactccccatccaactacgacatttctccaagcaactacgacaactccataagcaattacgacaatagtccatcaaattacgacaactctgagagcaactacgataatagttcatccaattacgacaatagtcgcaacggaaatcgtaggcttatatatagcgcaaatgggtctcgcactttcgccggctactacgtcattgccaacaatgggacaacgaacttcttttccacatctggcaaaaggatgttctacaccccaaaaggggggcgcggcgtctatggcggcaaagatgggagcttctgcggggcattggtcgtcataaatggccaattttcgcttgccctgacagataacggcctgaagatcatgtatctaagcaactagcctgctctctaataaaatgttaggagcttggctgccatttttggggtgaggccgttcgcggccgaggggcgcagcccctggggggatgggaggcccgcgttagcgggccgggagggttcgagaagggggggcaccccccttcggcgtgcgcggtcacgcgccagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaaggg

SEQ ID NO: 764 - DNA, 2435 bp, Artificial Sequence
  Description of Artificial Sequence: Synthetic Promoter
aaatacatgccagtgtggaataactatgcgaagttatcatttggtgcacttgcttgggtgaacttgatgccttactgaagttttatttttgaccatctttgttgtgatttaacatatttgagcgctaccgtacttatgacacttaaatgatgaaagttgctgtagggtgaatttggctgtttgacgcatggagattaggcattaacctttcttagttatgctgattatttcttgtgtgtctttttttccccctccttcagcatcacttgtttgcaagtggaagagatatgactttctttcaggtacttgttttcatacccatattaatacatctggttaaatcatgaaatttttgtattgatcgtttgtatgtccaatgacagtatgacctattcaatgacatttggttgtgtgctagatttcgttccagagaaaatgaaagcagaagatgcattggcagagaggaaaccagaagagacatgaatatgatactaatcttaggtcaagaagctgtaactttcattgattgaggggcttcaatttgtatgagcatcttatactgtgatttggttcttttcctgctatagcagaatagagccagcaaaatgggcacttacatttagctgcagatgatgtctgtatgggcgaattttttcgcatgttacattggagaagagaaatgcttatacttctggtaattttttcagcaaatagtctcatgccctgctaacatggatggtgggatagcttcttctggggagtgtaattaatctgtcatggacaagtactttgtagttaatctgattctcggcctatgttatatctgttttgcgttatactaaagatattcagatcaatctatgtcaatctattcacgaaaacccggggagtctaatgaggagagttgcatcttggcaatatagtttttaagaatggatatccagatccctacgaactggattcacacagtcactgctgtaagctctggttttttttagcttaggaagcaggttataatcaaagatgattaaaccatcgcgtgttcgccagccatcagaaatggaaaggcaaatgttgttatagtgatggacagatcatgctgagatgattgattatgaatcttactgatgactgtcatttatgttatcgcactctgtgtgtgtgggtgtgtgtaatgagtaatatcaaattaaccagacgataggtgttgaagattagctgttgggccgccgtggcaaaaggtgtcttatacaagccatcggcagtgacgcagaactgtagagaaccgctgtaacaagtcttcgaatgcattcttttaatgtacagcacgacatgaagggggttcaagtgtagcgaacagttcgtgcgagaaagatcattttcaatagcataaaagagtctgctctctgctgcaaacatggaaagaacttacatttcaatcattgaggagaagattataacaaatcctaaatggttgggattttagttagtccattcgaactaaagtggcgaagatgtcagtttttcaagtggatgatatttctcatgtatgttccgcagaggcaatcaccttgtttgtaactagacatctagagaacctaacaaggattgatgggggtgaggtgaaatgtctgtttcctctttaatatggatccagcgatgccttacagagcggatggatggcactggcaagtcttaatccttaggtcgaatgtttgattggtaacagatgccttttctttcttttcaatcacagctgacaaatgcaaatatctaaaaccattggctgtttggtgcttgcaagtctggattaccccactttatgtttcacctttcaataatgaataacaaggtactcgggaaaaaaaggaaagggaaattcgcacaaccaaagttgctatgcagaagtcaactcaatcctaatcaagttgatgagagtgttgggccctattttctgcagcaaacatgaatctcgattcatctccctcgcaaaagataaggaagctgcaaaagctttcctcctaagtttgttggcaggcaaattgattttgtaccagaaataaatacaaagtgaaacccaagcaatcacgcatggcctgatttgtgccatgtccatttgatctccctctaccatttttcctgctttctcaagcaaactagttgctgtaacagtgaatgatcccccggctctctctctctctctctctctctccatttattccatccatgtttttgcttttcgcacaacacttatcattgaggtgctaactactgaattcccctaactaaaaattggaacctctcacctaatttcattttctcccactttgatgagcaccactctctttcccagatttcaaataaattgccactctctccctcctctttcctcacacaaccaaaagccttcttcaagtaccacttcttcactgtcc

SEQ ID NO: 765 - DNA, 2184 bp, Pinus radiata
gtcgtctgtaaattactctgtgagtgtttagtgttttcttctcttattgatttcaggggacaagtaggtgggggtgggggagcttaagtcaaatctagtgctttctctgtaagattttcccttttttttcttgctaagagtagccatgattgaggtacagtcagctccccccatggcacggtccactgagaacgagaataaccagcatgatgccgaagaaggggcggtattgaatgagggcggcatggattttctgtatcggtcaaagcttccagacatagatattccataccatcttccattgcactcgtattgcttcgagaaactggacgagctcagagagaagccatgtctgatacaggggtcgaacgggaagatttacagctatggcgaagtggaattgatatctcgcaaggtggcctcgggtttggccaaattgggattcaaaaagggggacgtggtcatgctgctgctgcccaattgccccgaatttgtctttgttttcctaggggcgtccatggctggtgccattgccaccacggcgaaccctttttacactccctccgatattgccaaacagcggggcgcatcgggcgctcggctgattgtcacttacgctgcttgcgtagaaaagctgagggacctaatggagaatcatggggtccaagtgataaccatcgacaaccctccaaagggctgcgaacacatttcacttttgttggacggcgacgagaacgaatactgccctgcagactgtatcgtccagcccgacgacacggtcgcgctgccttattcatcgggcacgacggggctccccaagggtgtcatgttgacacacaaggggctcgtctctagcgtcgcccaacaagtcgatggagaaaatcccaatctgtatttgcattctgaggatgtggtgctctgcgtactgcctctgtttcatatctactcgctcaattctgtgctgctctgctcgctcagggccgggtctgctattctgctcatgcacaagtttgagatcgggagcctgctggatctggtgcagaggttcaaggtcacggtagcgcctgtcgtgcctcccattgttctcgcctttgccaagaacgcgctcgtggaaagctatgatctgtcgtccattagggttgtgctgtccggtgccgcgcctctcggaaaggagctggaggatgcattgaggctacgacttcccaaagccacttttggtcagggatacggtatgacagaggcaggaccggtgctatcaatgtgtctggccttcgctaaggagccctttccgatgaagtccgggtcgtgtggaacggttgttcggaatgcccagatgaagatcattgaccccgacacgggcacgtgtcttccctacaaccaacctggagaaatttgcatcagagggccccagattatgaaagggtatctgaacgatgctgagtctacagccagaactatcgatgaagatgggtggctgcatactggggatattggttatattgatgacgatgaagaagttttcattgtggacagagtgaaagagattatcaaatataagggttttcaggtacctccagctgagttagaagccattctcatcactcatccatctattgcagatgcagcagttgtacctcaaaaggatgaagttgcaggagaggttccagtagcctttgtggtgagatcaaatggatttgatcttacagaagatgaaatcaaacaatttgtggctaaacaggtggtgttctacaaaaagctgcacaaggtctatttcatccacgcaattcccaagtctccttctggaaaaatactgcgaaaggatttgagggcgaagctctctgcccccacctccaccgttgaaatcaaagcatgatattcttttctctaatcgatttgatcacttcaaccagaatttgtgggcatgccatagacgcatgagggcggccaatacctgtcactccaataatgtcaccgctttctggactcctttttcgagatatatttatggattcctgcttctctgtaagggtggcatgattattaagagtaattaggatagagagaaagccattgaatagtgtgccatatttctgattcacatcgcttctttcatggtctcctttacagttagttgtaagtttctccacctccattgcgtttggttgttacgtggattatgtgttt

SEQ ID NO: 766 - protein, 575 aa, Pinus radiata
MIEVQSAPPMARSTENENNQHDAEEGAVLNEGGMDFLYRSKLPDIDIPYHLPLHSYCFEKLDELREKPCLIQGSNGKIYSYGEVELISRKVASGLAKLGFKKGDVVMLLLPNCPEFVFVFLGASMAGAIATTANPFYTPSDIAKQRGASGARLIVTYAACVEKLRDLMENHGVQVITIDNPPKGCEHISLLLDGDENEYCPADCIVQPDDTVALPYSSGTTGLPKGVMLTHKGLVSSVAQQVDGENPNLYLHSEDVVLCVLPLFHIYSLNSVLLCSLRAGSAILLMHKFEIGSLLDLVQRFKVTVAPVVPPIVLAFAKNALVESYDLSSIRVVLSGAAPLGKELEDALRLRLPKATFGQGYGMTEAGPVLSMCLAFAKEPFPMKSGSCGTVVRNAQMKIIDPDTGTCLPYNQPGEICIRGPQIMKGYLNDAESTARTIDEDGWLHTGDIGYIDDDEEVFIVDRVKEIIKYKGFQVPPAELEAILITHPSIADAAVVPQKDEVAGEVPVAFVVRSNGFDLTEDEIKQFVAKQVVFYKKLHKVYFIHAIPKSPSGKILRKDLRAKLSAPTSTVEIKA

SEQ ID NO: 767 - DNA, 60 bp, Pinus radiata
tgtaagggtggcatgattattaagagtaattaggatagagagaaagccattgaatagtgt

SEQ ID NO: 768 - DNA, 2061 bp, Eucalyptus grandis
gcaacctcaaaacaaacgctgtctcgccccccccggctgcgctatataatgcagccgatggcgtccttcctttctcgaaccctaagcaaatcaagagtttgagtctaaaccttgtctaatcctctctcgcatagtcatttggagacgaagtgctgatcggccgcagctgcattctcttcgtaaaacatggcggctgtcggcaaaacctctttcctcttgggagctctcctcctcttctctgtggcggtgacattggcagatgcaaaagtttactaccatgattttgtcgttcaagcgaccaaggtgaagaggctgtgcacgacccacaacaccatcacggtgaacgggcaattcccgggtccgactttggaagttaacgacggcgacaccctcgttgtcaatgtcgtcaacaaagctcgctacaacgtcaccattcactggcacggcgtccggcaggtgagatctggttgggccgatgggccggaatttgtgactcaatgcccgattagacccggcggaagttacacgtaccgtttcaccatccaaggacaggtaggaacgctgtggtggcatgcacatagctcttggctaagagcgactgtgtatggtgctcttgtcattcgtccaaaggaaggcacctcgtatccgtttcccaagccgaagcgtgaaactcccatccttctcggggagtggtgggacgccaaccctattgacgtcgtgagagaagcgaccagaaccggcggggcaccgaacgtgtccgacgcttataccatcaacggtcaacctggagatctctacaactgctcaagcaaagacaccgtcatagttccgatcgattccggggagacccacctcctccgagtcatcaacgctgcgctcaatcaggaactcttcttcaccgtagcgaaccataggttcactgtggtcggtgccgacgcctcctacctgaaacccttcaccacctcggtgatcatgcttgggccaggccaaacgacggatgtattgatctctggagaccagcccccggctcggtactacatggcggccgaaccctaccagagtgctcagggagcgccttttgacaacaccacgaccacggccatactggagtacaagtccgccccgtgccccgccaagggcatatcgagcaagccagtcatgccaaccctaccggctttcaacgacacggctaccgtcacagccttcattcagagcttcaggagcccaaataaggttgacgtcccgaccgacatcgacgaaaacctctttatcacggtcggcctaggactcttcaactgcccaaagaatttcggtagcagtaggtgccaggggccgaatgggacccgtttcacggccagcatgaacaacgtgtccttcgtgctgccgtctaatgtctcgatcctgcaagcctacaagcagggcgtgcctggagtttttaccaccgatttccctgctaacccccctgtccagttcgattacacggggaacgtgagccgctcgctgtggcagcccgttccggggaccaaggtgtacaagttgaagtacgggtctagagtacagattgtcttgcaaggaaccaacatacaaacggccgagaaccacccgatccacattcacgggtacgatttctacatcctcgccacaggcttcgggaacttcaacccccagaaagatacagcgaagttcaaccttgtcgacccgccaatgaggaacacagttggcgtctctgtgaacgggtgggctgtcattagatttgtcgccgacaatccaggtgcttggttgatgcactgtcacttggatgttcacatcacctggggattggccgtggttttccttgtcgagaatggagttggcgaattgcaatctctacagcctcctcctgcagatttgcctccatgttaaaagatctgcggctgacagatagtcctccacgagaaattcataacgcccacaacacgggcctattctaattttcttcttcttctttcccctttccgttttcgtttcgcggagtttcagttcagtgattgtttcccctgaattcagggagcaaaaaaaaaa

SEQ ID NO: 769 - protein, 571 aa, Eucalyptus grandis
MAAVGKTSFLLGALLLFSVAVTLADAKVYYHDFVVQATKVKRLCTTHNTITVNGQFPGPTLEVNDGDTLVVNVVNKARYNVTIHWHGVRQVRSGWADGPEFVTQCPIRPGGSYTYRFTIQGQVGTLWWHAHSSWLRATVYGALVIRPKEGTSYPFPKPKRETPILLGEWWDANPIDVVREATRTGGAPNVSDAYTINGQPGDLYNCSSKDTVIVPIDSGETHLLRVINAALNQELFFTVANHRFTVVGADASYLKPFTTSVIMLGPGQTTDVLISGDQPPARYYMAAEPYQSAQGAPFDNTTTTAILEYKSAPCPAKGISSKPVMPTLPAFNDTATVTAFIQSFRSPNKVDVPTDIDENLFITVGLGLFNCPKNFGSSRCQGPNGTRFTASMNNVSFVLPSNVSILQAYKQGVPGVFTTDFPANPPVQFDYTGNVSRSLWQPVPGTKVYKLKYGSRVQIVLQGTNIQTAENHPIHIHGYDFYILATGFGNFNPQKDTAKFNLVDPPMRNTVGVSVNGWAVIRFVADNPGAWLMHCHLDVHITWGLAVVFLVENGVGELQSLQPPPADLPPC

SEQ ID NO: 770 - DNA, 60 bp, Eucalyptus grandis
acctctttatcacggtcggcctaggactcttcaactgcccaaagaatttcggtagcagta

SEQ ID NO: 771 - DNA, 35 bp, Artificial Sequence
  Description of Artificial Sequence: Synthetic Primer
gagagactcgagcttcttgcctcaattccggaggt

SEQ ID NO: 772 - DNA, 38 bp, Artificial Sequence
  Description of Artificial Sequence: Synthetic Primer
gagagaccatggccatctgttaatcagaaaaaccgaga

SEQ ID NO: 773-774 - skipped (2 entries)

SEQ ID NO: 775 - DNA, 3448 bp, Artificial Sequence
  Description of Artificial Sequence: Synthetic DNA construct
cgatgggtgttatttgtggataataaattcgggtgatgttcagtgtttgtcgtatttctcacgaataaattgtgtttatgtatgtgttagtgttgtttgtctgtttcagaccctcttatgttatatttttcttttcgtcggtcagttgaagccaatactggtgtcctggccggcactgcaataccatttcgtttaatataaagactctgttatccgtgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgcggccgcatttaaatggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggggccgctctagaactagtggatcccccgggctgcaggaattcgtccagcagttgtctggagctccaccagaaatctggaagcttat

SEQ ID NO: 776 - DNA, 53 bp, Artificial Sequence
  Description of Artificial Sequence: Synthetic Primer
aaatctagaggtaccatttaaatgcggccgcaaaacccctcacaaatacataa

SEQ ID NO: 777 - DNA, 36 bp, Artificial Sequence
  Description of Artificial Sequence: Synthetic Primer
tttctgcagcttgaaattgaaatatgactaacgaat

SEQ ID NO: 778 - DNA, 5534 bp, Artificial Sequence
  Description of Artificial Sequence: Synthetic DNA construct
tctagaggtaccatttaaatgcggccgcaaaacccctcacaaatacataaaaaaaattctttatttaattatcaaactctccactacctttcccaccaaccgttacaatcctgaatgttggaaaaaactaactacattgatataaaaaaactacattacttcctaaatcatatcaaaattgtataaatatatccactcaaaggagtctagaagatccacttggacaaattgcccatagttggaaagatgttcaccaagtcaacaagatttatcaatggaaaaatccatctaccaaacttactttcaagaaaatccaaggattatagagtaaaaaatctatgtattattaagtcaaaaagaaaaccaaagtgaacaaatattgatgtacaagtttgagaggataagacattggaatcgtctaaccaggaggcggaggaattccctagacagttaaaagtggccggaatcccggtaaaaaagattaaaatttttttgtagagggagtgcttgaatcatgttttttatgatggaaatagattcagcaccatcaaaaacattcaggacacctaaaattttgaagtttaacaaaaataacttggatctacaaaaatccgtatcggattttctctaaatataactagaattttcataactttcaaagcaactcctcccctaaccgtaaaacttttcctacttcaccgttaattacattccttaagagtagataaagaaataaagtaaataaaagtattcacaaaccaacaatttatttcttttatttacttaaaaaaacaaaaagtttatttattttacttaaatggcataatgacatatcggagatccctcgaacgagaatcttttatctccctggttttgtattaaaaagtaatttattgtggggtccacgcggagttggaatcctacagacgcgctttacatacgtctcgagaagcgtgacggatgtgcgaccggatgaccctgtataacccaccgacacagccagcgcacagtatacacgtgtcatttctctattggaaaatgtcgttgttatccccgctggtacgcaaccaccgatggtgacaggtcgtctgttgtcgtgtcgcgtagcgggagaagggtctcatccaacgctattaaatactcgccttcaccgcgttacttctcatcttttctcttgcgttgtataatcagtgcgatattctcagagagcttttcattcaaaggtatggagttttgaagggctttactcttaacatttgtttttctttgtaaattgttaatggtggtttctgtgggggaagaatcttttgccaggtccttttgggtttcgcatgtttatttgggttatttttctcgactatggctgacattactagggctttcgtgctttcatctgtgttttcttcccttaataggtctgtctctctggaatatttaattttcgtatgtaagttatgagtagtcgctgtttgtaataggctcttgtctgtaaaggtttcagcaggtgtttgcgttttattgcgtcatgtgtttcagaaggcctttgcagattattgcgttgtactttaatattttgtctccaaccttgttatagtttccctcctttgatctcacaggaaccctttcttctttgagcattttcttgtggcgttctgtagtaatattttaattttgggcccgggttctgagggtaggtgattattcacagtgatgtgctttccctataaggtcctctatgtgtaagctgttagggtttgtgcgttactattgacatgtcacatgtcacatattttcttcctcttatccttcgaactgatggttctttttctaattcgtggattgctggtgccatattttatttctattgcaactgtattttagggtgtctctttctttttgatttcttgttaatatttgtgttcaggttgtaactatgggttgctagggtgtctgccctcttcttttgtgcttctttcgcagaatctgtccgttggtctgtatttgggtgatgaattatttattccttgaagtatctgtctaattagcttgtgatgatgtgcaggtatattcgttagtcatatttcaatttcaagcgatcccccgggctgcaggaattcgtccagcagttgtctggagctccaccagaaatctggaagcttatcgatgggtgttatttgtggataataaattcgggtgatgttcagtgtttgtcgtatttctcacgaataaattgtgtttatgtatgtgttagtgttgtttgtctgtttcagaccctcttatgttatatttttcttttcgtcggtcagttgaagccaatactggtgtcctggccggcactgcaataccatttcgtttaatataaagactctgttatccgtgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgcggccgcatttaaatggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggggccgctctag

SEQ ID NO: 779 - DNA, 35 bp, Artificial Sequence
  Description of Artificial Sequence: Synthetic Primer
aaaatcgatctgcaggccatggattcttctcttca

SEQ ID NO: 780 - DNA, 35 bp, Artificial Sequence
  Description of Artificial Sequence: Synthetic Primer
tttctgcagatcgatcaatcattcgatcaatagag

SEQ ID NO: 781 - DNA, 7096 bp, Artificial Sequence
  Description of Artificial Sequence: Synthetic DNA construct
tctagaggtaccatttaaatgcggccgcaaaacccctcacaaatacataaaaaaaattctttatttaattatcaaactctccactacctttcccaccaaccgttacaatcctgaatgttggaaaaaactaactacattgatataaaaaaactacattacttcctaaatcatatcaaaattgtataaatatatccactcaaaggagtctagaagatccacttggacaaattgcccatagttggaaagatgttcaccaagtcaacaagatttatcaatggaaaaatccatctaccaaacttactttcaagaaaatccaaggattatagagtaaaaaatctatgtattattaagtcaaaaagaaaaccaaagtgaacaaatattgatgtacaagtttgagaggataagacattggaatcgtctaaccaggaggcggaggaattccctagacagttaaaagtggccggaatcccggtaaaaaagattaaaatttttttgtagagggagtgcttgaatcatgttttttatgatggaaatagattcagcaccatcaaaaacattcaggacacctaaaattttgaagtttaacaaaaataacttggatctacaaaaatccgtatcggattttctctaaatataactagaattttcataactttcaaagcaactcctcccctaaccgtaaaacttttcctacttcaccgttaattacattccttaagagtagataaagaaataaagtaaataaaagtattcacaaaccaacaatttatttcttttatttacttaaaaaaacaaaaagtttatttattttacttaaatggcataatgacatatcggagatccctcgaacgagaatcttttatctccctggttttgtattaaaaagtaatttattgtggggtccacgcggagttggaatcctacagacgcgctttacatacgtctcgagaagcgtgacggatgtgcgaccggatgaccctgtataacccaccgacacagccagcgcacagtatacacgtgtcatttctctattggaaaatgtcgttgttatccccgctggtacgcaaccaccgatggtgacaggtcgtctgttgtcgtgtcgcgtagcgggagaagggtctcatccaacgctattaaatactcgccttcaccgcgttacttctcatcttttctcttgcgttgtataatcagtgcgatattctcagagagcttttcattcaaaggtatggagttttgaagggctttactcttaacatttgtttttctttgtaaattgttaatggtggtttctgtgggggaagaatcttttgccaggtccttttgggtttcgcatgtttatttgggttatttttctcgactatggctgacattactagggctttcgtgctttcatctgtgttttcttcccttaataggtctgtctctctggaatatttaattttcgtatgtaagttatgagtagtcgctgtttgtaataggctcttgtctgtaaaggtttcagcaggtgtttgcgttttattgcgtcatgtgtttcagaaggcctttgcagattattgcgttgtactttaatattttgtctccaaccttgttatagtttccctcctttgatctcacaggaaccctttcttctttgagcattttcttgtggcgttctgtagtaatattttaattttgggcccgggttctgagggtaggtgattattcacagtgatgtgctttccctataaggtcctctatgtgtaagctgttagggtttgtgcgttactattgacatgtcacatgtcacatattttcttcctcttatccttcgaactgatggttctttttctaattcgtggattgctggtgccatattttatttctattgcaactgtattttagggtgtctctttctttttgatttcttgttaatatttgtgttcaggttgtaactatgggttgctagggtgtctgccctcttcttttgtgcttctttcgcagaatctgtccgttggtctgtatttgggtgatgaattatttattccttgaagtatctgtctaattagcttgtgatgatgtgcaggtatattcgttagtcatatttcaatttcaagcgatcccccgggctgcaggccatggattcttctcttcatgaagccttgcaaccactacccatgacgctgttcttcattatacctttgctactcttattgggcctagtatctcggcttcgccagagactaccatacccaccaggcccaaaaggcttaccggtgatcggaaacatgctcatgatggatcaactcactcaccgaggactcgccaaactcgccaaacaatacggcggtctattccacctcaagatgggattcttacacatggtggccgtttccacacccgacatggctcgccaagtccttcaagtccaagacaacatcttctcgaaccggccagccaccatagccatcagctacctcacctatgaccgagccgacatggccttcgctcactacggcccgttttggcgtcagatgcgtaaactctgcgtcatgaaattatttagccggaaacgagccgagtcgtgggagtcggtccgagacgaggtcgactcggcagtacgagtggtcgcgtccaatattgggtcgacggtgaatatcggcgagctggtttttgctctgacgaagaatattacttacagggcggcttttgggacgatctcgcatgaggaccaggacgagttcgtggccatactgcaagagttttcgcagctgtttggtgcttttaatatagctgattttatcccttggctcaaatgggttcctcaggggattaacgtcaggctcaacaaggcacgaggggcgcttgatgggtttattgacaagatcatcgacgatcatatacagaaggggagtaaaaactcggaggaggttgatactgatatggtagatgatttacttgctttttacggtgaggaagccaaagtaagcgaatctgacgatcttcaaaattccatcaaactcaccaaagacaacatcaaagctatcatggacgtaatgtttggagggaccgaaacggtggcgtccgcgattgaatgggccatgacggagctgatgaaaagcccagaagatctaaagaaggtccaacaagaactcgccgtggtggtgggtcttgaccggcgagtcgaagagaaagacttcgagaagctcacctacttgaaatgcgtactgaaggaagtccttcgcctccacccacccatcccactcctcctccacgagactgccgaggacgccgaggtcggcggctactacattccggcgaaatcgcgggtgatgatcaacgcgtgcgccatcggccgggacaagaactcgtgggccgacccagatacgtttaggccctccaggtttctcaaagacggtgtgcccgatttcaaagggaacaacttcgagttcatcccattcgggtcaggtcgtcggtcttgccccggtatgcaactcggactctacgcgctagagacgactgtggctcacctccttcactgtttcacgtgggagttgccggacgggatgaaaccgagtgaactcgagatgaatgatgtgtttggactcaccgcgccaagagcgattcgactcaccgccgtgccgagtccacgccttctctgtcctctctattgatcgaatgattgatcgatctgcaggaattcgtccagcagttgtctggagctccaccagaaatctggaagcttatcgatgggtgttatttgtggataataaattcgggtgatgttcagtgtttgtcgtatttctcacgaataaattgtgtttatgtatgtgttagtgttgtttgtctgtttcagaccctcttatgttatatttttcttttcgtcggtcagttgaagccaatactggtgtcctggccggcactgcaataccatttcgtttaatataaagactctgttatccgtgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgcggccgcatttaaatggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggggccgctctag

SEQ ID NO: 782 - DNA, 33 bp, Artificial Sequence
  Description of Artificial Sequence: Synthetic Primer
aaactgcagatcgatccgggcctcaaaaaatgg

SEQ ID NO: 783 - DNA, 35 bp, Artificial Sequence
  Description of Artificial Sequence: Synthetic Primer
gaagatttgagtccttactcatcgatctgcagaaa

SEQ ID NO: 784-785 - skipped (2 entries)

SEQ ID NO: 786 - DNA, 7527 bp, Artificial Sequence
  Description of Artificial Sequence: Synthetic DNA construct
gatctgcccgggcggtaccgcggccgcaaaatacatgccagtgtggaataactatgcgaagttatcatttggtgcacttgcttgggtgaacttgatgccttactgaagttttatttttgaccatctttgttgtgatttaacatatttgagcgctaccgtacttatgacacttaaatgatgaaagttgctgtagggtgaatttggctgtttgacgcatggagattaggcattaacctttcttagttatgctgattatttcttgtgtgtctttttttccccctccttcagcatcacttgtttgcaagtggaagagatatgactttctttcaggtacttgttttcatacccatattaatacatctggttaaatcatgaaatttttgtattgatcgtttgtatgtccaatgacagtatgacctattcaatgacatttggttgtgtgctagatttcgttccagagaaaatgaaagcagaagatgcattggcagagaggaaaccagaagagacatgaatatgatactaatcttaggtcaagaagctgtaactttcattgattgaggggcttcaatttgtatgagcatcttatactgtgatttggttcttttcctgctatagcagaatagagccagcaaaatgggcacttacatttagctgcagatgatgtctgtatgggcgaattttttcgcatgttacattggagaagagaaatgcttatacttctggtaattttttcagcaaatagtctcatgccctgctaacatggatggtgggatagcttcttctggggagttaggtgttttgtaattaatctgtcatggacaagtactttgtagttaatctgattctcggcctatgttatatctgttttgcgttatactaaagatattcagatcaatctatgtcaatctattcacgaaaacccggggagtctaatgaggagagttgcatcttggcaatatagtttttaagaatggatatccagatccctacgaactggattcacacagtcactgctgtaagctctggttttttttagcttaggaagcaggttataatcaaagatgattaaaccatcgcgtgttcgccagccatcagaaatggaaaggcaaatgttgttatagtgatggacagatcatgctgagatgattgattatgaatcttactgatgactgtcatttatgttatcgcactctgtgtgtgtgggtgtgtgtaatgagtaatatcaaattaaccagacgataggtgttgaagattagctgttgggccgccgtggcaaaaggtgtcttatacaagccatcggcagtgacgcagaactgtagagaaccgctgtaacaagtcttcgaatgcattcttttaatgtacagcacgacatgaagggggttcaagtgtagcgaacagttcgtgcgagaaagatcattttcaatagcataaaagagtctgctctctgctgcaaacatggaaagaacttacatttcaatcattgaggagaagattataacaaatcctaaatggttgggattttagttagtccattcgaactaaagtggcgaagatgtcagtttttcaagtggatgatatttctcatgtatgttccgcagaggcaatcaccttgtttgtaactagacatctagagaacctaacaaggattgatgggggtgaggtgaaatgtctgtttcctctttaatatggatccagcgatgccttacagagcggatggatggcactggcaagtcttaatccttaggtcgaatgtttgattggtaacagatgccttttctttcttttcaatcacagctgacaaatgcaaatatctaaaaccattggctgtttggtgcttgcaagtctggattaccccactttatgtttcacctttcaataatgaataacaaggtactcgggaaaaaaaggaaagggaaattcgcacaaccaaagttgctatgcagaagtcaactcaatcctaatcaagttgatgagagtgttgggccctattttctgcagcaaacatgaatctcgattcatctccctcgcaaaagataaggaagctgcaaaagctttcctcctaagtttgttggcaggcaaattgattttgtaccagaaataaatacaaagtgaaacccaagcaatcacgcatggcctgatttgtgccatgtccatttgatctccctctaccatttttcctgctttctcaagcaaactagttgctgtaacagtgaatgatcccccggctctctctctctctctctctctctccatttattccatccatgtttttgcttttcgcacaacacttatcattgaggtgctaactactgaattcccctaactaaaaattggaacctctcacctaatttcattttctcccactttgatgagcaccactctctttcccagatttcaaataaattgccactctctccctcctctttcctcacacaaccaaaagccttcttcaagtaccacttcttcactgtccagatcccccgggctgcaggaattcgtccagcagttgtctggagctccaccagaaatctggaagcttatcgaattcgattaaaatcgatctgcaggccatggattcttctcttcatgaagccttgcaaccactacccatgacgctgttcttcattatacctttgctactcttattgggcctagtatctcggcttcgccagagactaccatacccaccaggcccaaaaggcttaccggtgatcggaaacatgctcatgatggatcaactcactcaccgaggactcgccaaactcgccaaacaatacggcggtctattccacctcaagatgggattcttacacatggtggccgtttccacacccgacatggctcgccaagtccttcaagtccaagacaacatcttctcgaaccggccagccaccatagccatcagctacctcacctatgaccgagccgacatggccttcgctcactacggcccgttttggcgtcagatgcgtaaactctgcgtcatgaaattatttagccggaaacgagccgagtcgtgggagtcggtccgagacgaggtcgactcggcagtacgagtggtcgcgtccaatattgggtcgacggtgaatatcggcgagctggtttttgctctgacgaagaatattacttacagggcggcttttgggacgatctcgcatgaggaccaggacgagttcgtggccatactgcaagagttttcgcagctgtttggtgcttttaatatagctgattttatcccttggctcaaatgggttcctcaggggattaacgtcaggctcaacaaggcacgaggggcgcttgatgggtttattgacaagatcatcgacgatcatatacagaaggggagtaaaaactcggaggaggttgatactgatatggtagatgatttacttgctttttacggtgaggaagccaaagtaagcgaatctgacgatcttcaaaattccatcaaactcaccaaagacaacatcaaagctatcatggacgtaatgtttggagggaccgaaacggtggcgtccgcgattgaatgggccatgacggagctgatgaaaagcccagaagatctaaagaaggtccaacaagaactcgccgtggtggtgggtcttgaccggcgagtcgaagagaaagacttcgagaagctcacctacttgaaatgcgtactgaaggaagtccttcgcctccacccacccatcccactcctcctccacgagactgccgaggacgccgaggtcggcggctactacattccggcgaaatcgcgggtgatgatcaacgcgtgcgccatcggccgggacaagaactcgtgggccgacccagatacgtttaggccctccaggtttctcaaagacggtgtgcccgatttcaaagggaacaacttcgagttcatcccattcgggtcaggtcgtcggtcttgccccggtatgcaactcggactctacgcgctagagacgactgtggctcacctccttcactgtttcacgtgggagttgccggacgggatgaaaccgagtgaactcgagatgaatgatgtgtttggactcaccgcgccaagagcgattcgactcaccgccgtgccgagtccacgccttctctgtcctctctattgatcgaatgattgatcgatctgcagaaaatcactagtgaattcgatgggtgttatttgtggataataaattcgggtgatgttcagtgtttgtcgtatttctcacgaataaattgtgtttatgtatgtgttagtgttgtttgtctgtttcagaccctcttatgttatatttttcttttcgtcggtcagttgaagccaatactggtgtcctggccggcactgcaataccatttcgtttaatataaagactctgttatccgtgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgcggccgcatttaaatggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggggccgctctagaactagtg

SEQ ID NO: 787-788 - skipped (2 entries)

SEQ ID NO: 789 - DNA, 334 bp, Pinus radiata
attcaattcttcccactgcaggctacatttgtcagacacgttttccgccatttttcgcctgtttctgcggagaatttgatcaggttcggattgggattgaatcaattgaaaggtttttattttcagtatttcgatcgccatggccaacggaatcaagaaggtcgagcatctgtacagatcgaagcttcccgatatcgagatctccgaccatctgcctcttcattcgtattgctttgagagagtagcggaattcgcagacagaccctgtctgatcgatggggcgacagacagaacttattgcttttcagaggtggaactgatttctcgcaaggtc

SEQ ID NO: 790 - DNA, 334 bp, Pinus radiata
gctgccggtctggcgaagctcgggttgcagcaggggcaggttgtcatgcttctccttccgaattgcatcgaatttgcgtttgtgttcatgggggcctctgtccggggcgccattgtgaccacggccaatcctttctacaagccgggcgagatcgccaaacaggccaaggccgcgggcgcgcgcatcatagttaccctggcagcttatgttgagaaactggccgatctgcagagccacgatgtgctcgtcatcacaatcgatgatgctcccaaggaaggttgccaacatatttccgttctgaccgaagccgacgaaacccaatgcccggccgtga

SEQ ID NO: 791 - DNA, 334 bp, Pinus radiata
caatccacccggacgatgtcgtggcgttgccctattcttccggaaccacggggctccccaagggcgtgatgttaacgcacaaaggcctggtgtccagcgttgcccagcaggtcgatggtgaaaatcccaatctgtatttccattccgatgacgtgatactctgtgtcttgcctcttttccacatctattctctcaattcggttctcctctgcgcgctcagagccggggctgcgaccctgattatgcagaaattcaacctcacgacctgtctggagctgattcagaaatacaaggttaccgttgccccaattgtgcctccaattgtcctggacat

SEQ ID NO: 792 - DNA, 334 bp, Pinus radiata
cacaaagagccccatcgtttcccagtacgatgtctcgtccgtccggataatcatgtccggcgctgcgcctctcgggaaggaactcgaagatgccctcagagagcgttttcccaaggccattttcgggcagggctacggcatgacagaagcaggcccggtgctggcaatgaacctagccttcgcaaagaatcctttccccgtcaaatctggctcctgcggaacagtcgtccggaacgctcaaataaagatcctcgatacagaaactggcgagtctctcccgcacaatcaagccggcgaaatctgcatccgcggacccgaaataatgaaaggatat

SEQ ID NO: 793 - DNA, 334 bp, Pinus radiata
attaacgacccggaatccacggccgctacaatcgatgaagaaggctggctccacacaggcgacgtcgggtacattgacgatgacgaagaaatcttcatagtcgacagagtaaaggagattatcaaatataagggcttccaggtggctcctgctgagctggaagctttacttgttgctcatccgtcaatcgctgacgcagcagtcgttcctcaaaagcacgaggaggcgggcgaggttccggtggcgttcgtggtgaagtcgtcggaaatcagcgagcaggaaatcaaggaattcgtggcaaagcaggtgattttctacaagaaaatacacagag

SEQ ID NO: 794 - DNA, 327 bp, Pinus radiata
tttactttgtggatgcgattcctaagtcgccgtccggcaagattctgagaaaggatttgagaagcagactggcagcaaaatgaaaatgaatttccatatgattctaagattcctttgccgataattataggattcctttctgttcacttctatttatataataaagtggtgcagagtaagcgccctataaggagagagagagcttatcaattgtatcatatggattgtcaacgccctacactcttgcgatcgctttcaatatgcatattactataaacgatatatgttttttttataaatttactgcacttctcgttcaaaaaaaaa

SEQ ID NO: 795 - DNA, 373 bp, Pinus radiata
attttcgggcagggctacggcatgacagaagcaggcccggtgctggcaatgaacctagccttcgcaaagaatcctttccccgtcaaatctggctcctgcggaacagtcgtccggaacgctcaaataaagatcctcgatacagaaactggcgagtctctcccgcacaatcaagccggcgaaatctgcatccgcggacccgaaataatgaaaggatatattaacgacccggaatccacggccgctacaatcgatgaagaaggctggctccacacaggcgacgtcgggtacattgacgatgacgaagaaatcttcatagtcgacagagtaaaggagattatcaaatataagggcttccaggtggctcctgctgagc

SEQ ID NO: 796 - DNA, 6629 bp, Artificial Sequence
  Description of Artificial Sequence: Synthetic DNA construct
cgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggcagtccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgatagacaactgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacaccgcggtctagaactagtggatcccccctacgtgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatccctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctggagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatagtactagttggggatctgcatctgaaataaaacaatagaacaagtagaaaccaatcagcgaacatataccaaatcaaaagccgtaagagaaatcaaaacaacaccaaagagaaacggatctaaacataagaaacctaaaacagagagaatcgaacaaagaaaacacaaaaattgaatagatcgtccttgaaaatcctaatttcacaatcaagcaagaaattacacagatgtaaacactacgaatcgatatcttagtaatcaggacaaaatttagaagctggattgacgaaacgaacaatattgtcaaaagcaatttatacaaaagattcaataatccacataacaaaaattggagatcagatacgaatcaaaaacaaaaagaatcagaaaatataccttgaaagagagagtcgcgagagatttgcagagatcgctttaggctttgggagagattgaagagtcagaaaaagacgaaaggatgaattattatcttccacacgaaggtcttctttatatcgcaaaccaaaagcccaaaaccgtcttttctattaatgagaataaaatatctttagccaaaacaaaaaaaggaagatatcagttgaggattattatcacgaaactaaaggaaggaatcatatgatacgtgtctattttccaccgtgcgtttttaaaagaccgactcaagtagaaacatcctatggtggtggttggattaggtcatccattacatctgcttcactgacatttttctatttttctttttgtatatacttttcctcaaataatttctttcttttctatagaagaatttaatcaataaggaaaaagttcaaaaaagattctttccattaagactatgtcttggttaacccaacccattaagaataagcaatcataatatatatagagaatactaatactatatatgagatttttcttttaatttcatgttgattatgatagtttatcttcttgatttaatttatcaatacttggcataaaagattctaatctactctaataaagaaaagaaaaaaaagtatctaccattgactaattaaaataaggaaacttatctaccaaatttgagtattttttagaacaatctttttggtttaattccaaaactctaaacctaattgttgggaaaaaggacctaatttttaagaaaagttaataattagaagatctgtatgtttttttttttgatccaagtttttatttcttttctctttttttcatgataaaatctatgtttttttagtctacaattaaagtaattgttattattttctttatctttttttgttgttgttgttaattccctttttttttttttaacagcaacttcttaaaaaaaaaaacagttgggccttgaatttatttcaggcctgcgttattaagcccagataataactcaaaacaaaaaaaatgttgaaccggaataaacccgcgagattaaatgccggttttcaggtaacatagaagaagaatatatgaggattgaagaagtattcaagaggcggaacaattcacaagtccaagagcttaaatttctcctcactcttctgctacagactcggaactctttctctttgctaaaataagatgttcaggatttttgttgcccgacaattcatgtatctcacactctctctcttctctgttcttactactctgttacattaccaccaactcaagactttcttccacaatggcgtttatgagacttggctccaaatccgaagcttatcgataccgtcgacctctagaggcgcgccaagcggccgcatttaaatgggccctcgagagcccgggctcctgcaggtaccttaattaaaagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttccccagatc

SEQ ID NO: 797 - skipped

SEQ ID NO: 798 - DNA, 39 bp, Artificial Sequence
  Description of Artificial Sequence: Synthetic Primer
gagagaccataattgtggtccaatttgcagccgtccgag

SEQ ID NO: 799 - DNA, 41 bp, Artificial Sequence
  Description of Artificial Sequence: Synthetic Primer
gagagaccataattgtggtttgtgtttccatattgttcatc

SEQ ID NO: 800 - DNA, 31 bp, Artificial Sequence
  Description of Artificial Sequence: Synthetic Primer
gagagaggatccggtgtgaaataccgcacag

SEQ ID NO: 801 - DNA, 39 bp, Artificial Sequence
  Description of Artificial Sequence: Synthetic Primer
gagagatgatcagcctcactgattaagcattggtaactg

SEQ ID NO: 802 - DNA, 1878 bp, Artificial Sequence
  Description of Artificial Sequence: Synthetic DNA construct
ggcgcgccgtcaacggatcaggatatccttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcataaatatcatccgatttgttcaaataatttgagttttgtcgaataattactcttcgatttgtgatttctatctagatctggtgttagtttctagtttgtgcgatcgaatttgtcgattaatctgagtttttctgattaacagatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactccaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagcgatcaggatgatctggacgaagagcatcaggggctcgcgccagccgaactgttcgccaggctcaaggcgcgcatgcccgacggcgaggatctcgtcgtgacccatgg

SEQ ID NO: 803 - DNA, 42 bp, Artificial Sequence
  Description of Artificial Sequence: Synthetic Primer
gagaggcgcgccgtcaacggatcaggatatccttgtttaaga

SEQ ID NO: 804 - DNA, 52 bp, Artificial Sequence
  Description of Artificial Sequence: Synthetic Primer
tgctggcaatccatcttgttcaatcatctgttaatcagaaaaactcagatta

SEQ ID NO: 805 - DNA, 52 bp, Artificial Sequence
  Description of Artificial Sequence: Synthetic Primer
taatctgagtttttctgattaacagatgattgaacaagatggattgcacgca

SEQ ID NO: 806 - DNA, 52 bp, Artificial Sequence
  Description of Artificial Sequence: Synthetic Primer
tattgccaaatgtttgaacgatccctcagaagaactcgtcaagaaggcgata

SEQ ID NO: 807 - DNA, 52 bp, Artificial Sequence
  Description of Artificial Sequence: Synthetic Primer
tatcgccttcttgacgagttcttctgagggatcgttcaaacatttggcaata

SEQ ID NO: 808 - DNA, 36 bp, Artificial Sequence
  Description of Artificial Sequence: Synthetic Primer
gagacactacgtgcgatctagtaacatagatgacac

SEQ ID NO: 809 - DNA, 12290 bp, Artificial Sequence
  Description of Artificial Sequence: Synthetic DNA construct
cgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggcagtccataattgtggtccaatttgcagccgtccgagacaggaggacatcgtccagctgaaaccggggcagaatccggccatttctgaagagaaaaatggtaaactgatagaataaaatcataagaaaggagccgcacatgaaaaaagcagtcattaacggggaacaaatcagaagtatcagcgacctccaccagacattgaaaaaggagcttgcccttccggaatactacggtgaaaacctggacgctttatgggattgtctgaccggatgggtggagtacccgctcgttttggaatggaggcagtttgaacaaagcaagcagctgactgaaaatggcgccgagagtgtgcttcaggttttccgtgaagcgaaagcggaaggctgcgacatcaccatcatactttcttaatacgatcaatgggagatgaacaatatggaaacacaaaccacaattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgatagacaactgtcacggttaagcgagaaatgaataagaaggctgataattcggatctctgcgagggagatgatatttgatccggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatatcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttcatcagtgaggctgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacaccgcggtctagaactagtggatcccccctacgtgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatccctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctggagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatctgttaatcagaaaaactcagattaatcgacaaattcgatcgcacaaactagaaactaacaccagatctagatagaaatcacaaatcgaagagtaattattcgacaaaactcaaattatttgaacaaatcggatgatatttatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaaggatatcctgatccgttgacggcgcgccaagcggccgcatttaaatgggccctcgagagcccaaatgcggccgcaaaacccctcacaaatacataaaaaaaattctttatttaattatcaaactctccactacctttcccaccaaccgttacaatcctgaatgttggaaaaaactaactacattgatataaaaaaactacattacttcctaaatcatatcaaaattgtataaatatatccactcaaaggagtctagaagatccacttggacaaattgcccatagttggaaagatgttcaccaagtcaacaagatttatcaatggaaaaatccatctaccaaacttactttcaagaaaatccaaggattatagagtaaaaaatctatgtattattaagtcaaaaagaaaaccaaagtgaacaaatattgatgtacaagtttgagaggataagacattggaatcgtctaaccaggaggcggaggaattccctagacagttaaaagtggccggaatcccggtaaaaaagattaaaatttttttgtagagggagtgcttgaatcatgttttttatgatggaaatagattcagcaccatcaaaaacattcaggacacctaaaattttgaagtttaacaaaaataacttggatctacaaaaatccgtatcggattttctctaaatataactagaattttcataactttcaaagcaactcctcccctaaccgtaaaacttttcctacttcaccgttaattacattccttaagagtgataaagaaataaagtaaataaaagtattcacaaaccaacaatttatttcttttatttacttaaaaaaacaaaaagtttatttattttacttaaatggcataatgacatatcggagatccctcgaacgagaatcttttatctccctggttttgtattaaaaagtaatttattgtggggtccacgcggagttggaatcctacagacgcgctttacatacgtctcgagaagcgtgacggatgtgcgaccggatgaccctgtataacccaccgacacagccagcgcacagtatacacgtgtcatttctctattggaaaatgtcgttgttatccccgctggtacgcaaccaccgatggtgacaggtcgtctgttgtcgtgtcgcgtagcgggagaagggtctcatccaacgctattaaatactcgccttcaccgcgttacttctcatcttttctcttgcgttgtataatcagtgcgatattctcagagagcttttcattcaaaggtatggagttttgaagggctttactcttaacatttgtttttctttgtaaattgttaatggtggtttctgtgggggaagaatcttttgccaggtccttttgggtttcgcatgtttatttgggttatttttctcgactatggctgacattactagggctttcgtgctttcatctgtgttttcttcccttaataggtctgtctctctggaatatttaattttcgtatgtaagttatgagtagtcgctgtttgtaataggctcttgtctgtaaaggtttcagcaggtgtttgcgttttattgcgtcatgtgtttcagaaggcctttgcagattattgcgttgtactttaatattttgtctccaaccttgttatagtttccctcctttgatctcacaggaaccctttcttctttgagcattttcttgtggcgttctgtagtaatattttaattttgggcccgggttctgagggtaggtgattattcacagtgatgtgctttccctataaggtcctctatgtgtaagctgttagggtttgtgcgttactattgacatgtcacatgtcacatattttcttcctcttatccttcgaactgatggttctttttctaattcgtggattgctggtgccatattttatttctattgcaactgtattttagggtgtctctttctttttgatttcttgttaatatttgtgttcaggttgtaactatgggttgctagggtgtctgccctcttcttttgtgcttctttcgcagaatctgtccgttggtctgtatttgggtgatgaattatttattccttgaagtatctgtctaattagcttgtgatgatgtgcaggtatattcgttagtcatatttcaatttcaagcgatcccccgggcccccatggatccagtagaaaccccaacccgtgaaatcaaaaaactcgacggcctgtgggcattcagtctggatcgcgaaaactgtggaattggtcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcaggtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgaatcaacaactctcctggcgcaccatcgtcggctacagcctcgggaattgctaccgagggttcgaaatcgatgggtgttatttgtggataataaattcgggtgatgttcagtgtttgtcgtatttctcacgaataaattgtgtttatgtatgtgttagtgttgtttgtctgtttcagaccctcttatgttatatttttcttttcgtcggtcagttgaagccaatactggtgtcctggccggcactgcaataccatttcgtttaatataaagactctgttatccgtgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgcggccgcatttgggctcctgcaggtaccttaattaaaagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttccccagatc

SEQ ID NO: 810 - DNA, 4289 bp, Artificial Sequence
  Description of Artificial Sequence: Synthetic DNA construct
cttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctgagagacataattgtggtttgtgtttccatattgttcatctcccattgatcgtattaagaaagtatgatggtgatgtcgcagccttccgctttcgcttcacggaaaacctgaagcacactctcggcgccattttcagtcagctgcttgctttgttcaaactgcctccattccaaaacgagcgggtactccacccatccggtcagacaatcccataaagcgtccaggttttcaccgtagtattccggaagggcaagctcctttttcaatgtctggtggaggtcgctgatacttctgatttgttccccgttaatgactgcttttttcatgtgcggctcctttcttatgattttattctatcagtttaccatttttctcttcagaaatggccggattctgccccggtttcagctggacgatgtcctcctgtctcggacggctgctgcaaattggaccacattatggtctctcagcttgcatgccaaacttttaattaaggtacctgcaggagcccgggctctcgagtaaaacataattttggcagtaaaaagtgaattctattgttttgaaaacaaaacaaaatacaggaagcgtgattgtggggttgttgttgaacttgcccgggcaaaagaagaatgattagcggtagaggagttagtagttacgttcaactaaatgcgtgactaaattatttatcctccgccatggaagcaggtgattcacacacaacttgctgcacacattgctctcaaacctttcctataaatatccgtagcaggggctgcgatgatacacaacgcatttaatcaaactactttgattactttctgtgggttctactttctttgaatagtcagttctgctgtttttagaagatttatgagaatggccaaaattcaggtatcaaacgggaacatggcacaggttatcaacacgtttgacggggttgcggattatcttcagacatatcataagctacctgataattacattacaaaatcagaagcacaagccctcggctgggtggcatcaaaagggaaccttgcagacgtcgctccggggaaaagcatcggcggagacatcttctcaaacagggaaggcaaactcccgggcaaaagcggacgaacatggcgtgaagcggatattaactatacatcaggcttcagaaattcagaccggattctttactcaagcgactggctgatttacaaaacaacggacgagtatcagacctttacaaaaatcagataacgaaaaaaacggcttccctgcgggaggccgtttttttcagctttacataaagtgtgtaataaatttttcttcaaactctgatcggtcaagagctcttctgagagacaatacatacatgtctctgatgttgtaactttactaccaaaacctataaagattggcttatttcgttctattggatatgtatcatcattactggtaaatcaagtttctttctaataatgtagaagatcagaaaatccataagaagatatcaacatttgagttctatggtaaattgaattatatcaacttagttgcaatgattcattcttgactgatgcattgatggcttatcaaaccagtttacaaaattcgattagatagggcccatttaaatgcggccgcttggcgcgcctgttaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggag

SEQ ID NO: 811 - DNA, 13383 bp, Artificial Sequence
  Description of Artificial Sequence: Synthetic DNA construct
cgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggcagtccataattgtggtccaatttgcagccgtccgagacaggaggacatcgtccagctgaaaccggggcagaatccggccatttctgaagagaaaaatggtaaactgatagaataaaatcataagaaaggagccgcacatgaaaaaagcagtcattaacggggaacaaatcagaagtatcagcgacctccaccagacattgaaaaaggagcttgcccttccggaatactacggtgaaaacctggacgctttatgggattgtctgaccggatgggtggagtacccgctcgttttggaatggaggcagtttgaacaaagcaagcagctgactgaaaatggcgccgagagtgtgcttcaggttttccgtgaagcgaaagcggaaggctgcgacatcaccatcatactttcttaatacgatcaatgggagatgaacaatatggaaacacaaaccacaattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgatagacaactgtcacggttaagcgagaaatgaataagaaggctgataattcggatctctgcgagggagatgatatttgatccggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatatcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttcatcagtgaggctgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacaccgcggtctagaactagtggatcccccctacgtgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatccctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctggagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatctgttaatcagaaaaactcagattaatcgacaaattcgatcgcacaaactagaaactaacaccagatctagatagaaatcacaaatcgaagagtaattattcgacaaaactcaaattatttgaacaaatcggatgatatttatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaaggatatcctgatccgttgacggcgcgccaagcggggccgcatttaaatgggccctatctaatcgaattttgtaaactggtttgataagccatcaatgcatcagtcaagaatgaatcattgcaactaagttgatataattcaatttaccatagaactcaaatgttgatatcttcttatggattttctgatcttctacattattagaaagaaacttgatttaccagtaatgatgatacatatccaatagaacgaaataagccaatctttataggttttggtagtaaagttacaacatcagagacatgtatgtattgtctctcagaagagctcttgaccgatcagagtttgaagaaaaatttattacacactttatgtaaagctgaaaaaaacggcctcccgcagggaagccgtttttttcgttatctgatttttgtaaaggtctgatactcgtccgttgttttgtaaatcagccagtcgcttgagtaaagaatccggtctgaatttctgaagcctgatgtatagttaatatccgcttcacgccatgttcgtccgcttttgcccgggagtttgccttccctgtttgagaagatgtctccgccgatgcttttccccggagcgacgtctgcaaggttcccttttgatgccacccagccgagggcttgtgcttctgattttgtaatgtaattatcaggtagcttatgatatgtctgaagataatccgcaaccccgtcaaacgtgttgataacctgtgccatgttcccgtttgatacctgaattttggccattctcataaatcttctaaaaacagcagaactgactattcaaagaaagtagaacccacagaaagtaatcaaagtagtttgattaaatgcgttgtgtatcatcgcagcccctgctacggatatttataggaaaggtttgagagcaatgtgtgcagcaagttgtgtgtgaatcacctgcttccatggcggaggataaataatttagtcacgcatttagttgaacgtaactactaactcctctaccgctaatcattcttcttttgcccgggcaagttcaacaacaaccccacaatcacgcttcctgtattttgttttgttttcaaaacaatagaattcactttttactgccaaaattatgttttactcgagagcccaaatgcggccgcaaaacccctcacaaatacataaaaaaaattctttatttaattatcaaactctccactacctttcccaccaaccgttacaatcctgaatgttggaaaaaactaactacattgatataaaaaaactacattacttcctaaatcatatcaaaattgtataaatatatccactcaaaggagtctagaagatccacttggacaaattgcccatagttggaaagatgttcaccaagtcaacaagatttatcaatggaaaaatccatctaccaaacttactttcaagaaaatccaaggattatagagtaaaaaatctatgtattattaagtcaaaaagaaaaccaaagtgaacaaatattgatgtacaagtttgagaggataagacattggaatcgtctaaccaggaggcggaggaattccctagacagttaaaagtggccggaatcccggtaaaaaagattaaaatttttttgtagagggagtgcttgaatcatgttttttatgatggaaatagattcagcaccatcaaaaacattcaggacacctaaaattttgaagtttaacaaaaataacttggatctacaaaaatccgtatcggattttctctaaatataactagaattttcataactttcaaagcaactcctcccctaaccgtaaaacttttcctacttcaccgttaattacattccttaagagtgataaagaaataaagtaaataaaagtattcacaaaccaacaatttatttcttttatttacttaaaaaaacaaaaagtttatttattttacttaaatggcataatgacatatcggagatccctcgaacgagaatcttttatctccctggttttgtattaaaaagtaatttattgtggggtccacgcggagttggaatcctacagacgcgctttacatacgtctcgagaagcgtgacggatgtgcgaccggatgaccctgtataacccaccgacacagccagcgcacagtatacacgtgtcatttctctattggaaaatgtcgttgttatccccgctggtacgcaaccaccgatggtgacaggtcgtctgttgtcgtgtcgcgtagcgggagaagggtctcatccaacgctattaaatactcgccttcaccgcgttacttctcatcttttctcttgcgttgtataatcagtgcgatattctcagagagcttttcattcaaaggtatggagttttgaagggctttactcttaacatttgtttttctttgtaaattgttaatggtggtttctgtgggggaagaatcttttgccaggtccttttgggtttcgcatgtttatttgggttatttttctcgactatggctgacattactagggctttcgtgctttcatctgtgttttcttcccttaataggtctgtctctctggaatatttaattttcgtatgtaagttatgagtagtcgctgtttgtaataggctcttgtctgtaaaggtttcagcaggtgtttgcgttttattgcgtcatgtgtttcagaaggcctttgcagattattgcgttgtactttaatattttgtctccaaccttgttatagtttccctcctttgatctcacaggaaccctttcttctttgagcattttcttgtggcgttctgtagtaatattttaattttgggcccgggttctgagggtaggtgattattcacagtgatgtgctttccctataaggtcctctatgtgtaagctgttagggtttgtgcgttactattgacatgtcacatgtcacatattttcttcctcttatccttcgaactgatggttctttttctaattcgtggattgctggtgccatattttatttctattgcaactgtattttagggtgtctctttctttttgatttcttgttaatatttgtgttcaggttgtaactatgggttgctagggtgtctgccctcttcttttgtgcttctttcgcagaatctgtccgttggtctgtatttgggtgatgaattatttattccttgaagtatctgtctaattagcttgtgatgatgtgcaggtatattcgttagtcatatttcaatttcaagcgatcccccgggcccccatggatccagtagaaaccccaacccgtgaaatcaaaaaactcgacggcctgtgggcattcagtctggatcgcgaaaactgtggaattggtcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcaggtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgaatcaacaactctcctggcgcaccatcgtcggctacagcctcgggaattgctaccggggttcgaaatcgatgggtgttatttgtggataataaattcgggtgatgttcagtgtttgtcgtatttctcacgaataaattgtgtttatgtatgtgttagtgttgtttgtctgtttcagaccctcttatgttatatttttcttttcgtcggtcagttgaagccaatactggtgtcctggccggcactgcaataccatttcgtttaatataaagactctgttatccgtgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgcggccgcatttgggctcctgcaggtaccttaattaaaagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttccccagatc

SEQ ID NO: 812 - DNA, 11300 bp, Artificial Sequence
  Description of Artificial Sequence: Synthetic DNA construct
cgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggcagtccataattgtgggctgagagacataattgtggtttgtgtttccatattgttcatctcccattgatcgtattaagaaagtatgatggtgatgtcgcagccttccgctttcgcttcacggaaaacctgaagcacactctcggcgccattttcagtcagctgcttgctttgttcaaactgcctccattccaaaacgagcgggtactccacccatccggtcagacaatcccataaagcgtccaggttttcaccgtagtattccggaagggcaagctcctttttcaatgtctggtggaggtcgctgatacttctgatttgttccccgttaatgactgcttttttcatgtgcggctcctttcttatgattttattctatcagtttaccatttttctcttcagaaatggccggattctgccccggtttcagctggacgatgtcctcctgtctcggacggctgctgcaaattggaccacattatggtctctcccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgatagacaactgtcacggttaagcgagaaatgaataagaaggctgataattcggatctctgcgagggagatgatatttgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggtttttcttttcaccagtgagacgggcaacagctgattgcccttcaccgcctggccctgagagagttgcagcaagcggtccacgctggtttgccccagcaggcgaaaatcctgtttgatggtggttccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccacggccgctctagaactagtggatccaccagaaccaccaccagagccgccgccagcattgacaggaggcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcagattgtcgtttcccgccttcagtttaaactatcagtgttgcggccgcggcgcgccttcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcaaagtgcaattgaccgatcagagtttgaagaaaaatttattacacactttatgtaaagctgaaaaaaacggcctcccgcagggaagccgtttttttcgttatctgatttttgtagaggtctgataatggtccgttgttttgtaaatcagccagtcgcttgagtaaagaatccggtctgaatttctgaagcctgatgtatagttaatatccgcttcacgccatgttcgtccgcttttgcccgggagtttgccttccctgtttgagaagatgtctccgccgatgcttttccccggagcgacgtctgcaaggttcccttttgatgccacccagccgagggcttgtgcttctgattttgtaatgtaattatcaggtagcttatgatatgtctgaagataatccgcaaccccgtcaaacgtgttgataacctgtgccatgatttgtacacaaaatttccgcgcacagatcctcacagcgtatgcaaaacaaagctgcaactactaataccagtccaaaagcaatgggcgcaacagcaacagcaaaagctgcaaccccttgtgctggttcgttcctacagttggacgcagcccgagttctgagaaacaaataaccacaaggcaagttaggtaccaaaccccttaagctcaacttaagcaaatattacaatcgtttgtttctacaaacaaatctttttcagaacggcttcaggtggggaatattgtccatttaagtacctgaaaatctaagaacacggccaatccgggcgcctttgcttgaaagtgggaagaaacctgaatgattgaacagtggataagagatttataagcaagattagcagggctgatcagattgttttttcgggtaggttgatcaatacatatgccccttccctcttcctttcctctacaatcgattgccagggagagatagagataccatcatgatgatgatggtggggatggcgatgatggtaatgatgatgatccagcagaaaaaattgcgcagaagaagaagatgagcggtcggtcggtcgatagcctttcagtcggaggggaaagaacaaaataatgcctatttgaaggcagatggattgactaagacgtgtgcaggcagtggaggagttacaaggcaggacatatttactaggtataggtgtaggtaatagtaatggagaggataaatttaggttttgggatgaatggatttgttggtacatgttgcaactcccacactgcaatcaaaggaccgctatgacaccccctgaatgcgacgcccatgagaatgccgaccccacatatacatttctggaaataatagggaaatgcacccttgcattatatttcatttattcgtcctccattttgtgcgctctccattcattttcaaatgcgctccactcttcctttatttcttaccaccattatctcgtattcgaggtccagaaatcaagttgtgaatctgccttggttgcgcattgttaaagtactcttctgtgtatatttctgccccaccgttttcacttccaacacttaaatttttttattttttattttatatatttcttataaattgttggcttctcacacgaacccaagccatccaagccccgacaaaggcaatccaatgtacttgactagagtcaaataccttttacttctttacttctcatattacccagaagccaagccaaccttaccaaactaatgtacctgagcagagtccactacctttcctcaagtacagtggcagtcagagtatatcaccgcttgttatgtatatgctttaatgctatgcttatttctaggtcataatctaaatcatatttgctgtcgagtttaagcttatcgataccgtcgacctcgagcttcttcttgaatgctcttatgggtaggattatttttcacttttttccttcatattccacacacatatatatataaacacactaacattagtgggaatatttgtttgatatgtttattttatttacttcgggggtttttgtaacaattttgtagatctaatttcttgtcttcatgtgtatattaattttcccttaagacttaaataaaaagagagagtttgttatatatagatatatgaagtgagggaaatggtacaaagttaaaggagatctgagtgagagttagataataaatgaaaagaaataagaaaccatcagggttttttctaatgtggagttttagattcagttttgtagaactaagattcactttgttgggtgttctttcttcactcatttctgttattataataataataaaatcttatatctttctattttccttactaacaagtacttgaagatttagatatatttatagatctggtgttgtaataggtaaaaacttgatttttatgactataaaagtaagttttgggaaacaaattggggagagagtaaggaaggactatgaggtcatatcttctgttttgtgatcatccatcctccattgttgttaatgtctgtgtctctctttttcttctcttctttctcttactttcctttcttatctctagctctctttctctctcatgaattatatcatatcatatatttgatacaaacacatgtgatggtaagtgagagtgaataaggtgaaactagctagatttttgagttttcatgaaattttaacttatatgagtgatagaaaataatggaacttatacgtacatgtaggacaatttagatggttatctaagtttttgtttttgttttctcttgagaatgttaaatgttagtgttatttttgtagttttggaaaattatatatgagctaagattagtttagaagtggtcaaaagaaacatagatttgaaatttcaactgaattttcaagatttcaaatagtcaatgaaacaaggaggtaattaagacaaattagcttatggggactcttttttgttattccttaaaattactctttttaaaattaaaaataactaatctcatttcgaactacattactcaaactagtaatctctaattcgacacgcaatttccaaatacttattagtagagagtcccacgtgattactttcttctccaccaaaacataaaacatgtcaagattaaatggtgtttgaaaattaaaagatcaattttcttaatcgtttacagttgtcaactctcatgtcctgaaatatataattctcatgtccaaaacaagaaaagctaacaacgacttcaaattaaatcagtcaatcaaaattagtcttcatttacctactaatttctttttatatatccgatgggtactctacgaaatcagagtttcgtttctttatttattttcttttataagatttttgaggttttttcagaggttggaattgagcgcaagattaggttttgggtctgtaagatttgttgtctttgttaaagaatctttgatcacgtcatcactcagatattatttctttttatttttcatttgtatttttactaatttattataaagttttgttagtttcagttcttgacttctgacaagaaggttttatgtcataatgaattaatttgtaacctatttataaattcaaaaatgtcatcatattactacttttgaccatttaatattagatttctcatttggtcaatacccaatgttcatattacatatatagagacaaaaattataaggatactaaattgttcatatttcttggaagtaaaaagattaatgatcactgaataaatagatttggcatagaagtatagcattggaattgcttcaacatctttggtgtagatagatttatgcaatttctctttctttttgaagtatctttttttttctagagagagaataatgttagggatttttatcattttctctctcattatgggtactgagaggaaagtgagatttttagtacggatccaatagtttaagagtttggtctgccttctacgatccaaaaaaatctacggtcatgatctctccatcgagaaggttgagagttcagacatcaaagtctataatatgtcattgtaatacgtatttgtgcatatatatctatgtacaagtacatatacaggaaactcaagaaaaaagaataaatggtaaatttaattatattccaaataaggaaagtatggaacgttgtgatgttactcggacaagtcatttagttacatccatcacgtttaaatttaatccaatggttacaattttaatactatcaaatgtctattggatttatacccaatgtgttaatgggttgttgacacatgtcacatgtctgaaaccctagacatgttcagaccaatcatgtcactctaattttgccagcatggcagttggcagccaatcactagctcgataaatttaaggtttcagaggaattttaatttatttagggttcatattgtttcataaaatgattctttatttgttacaactttaaggaaatattttattaactatttaattgttcccttttcttatattacttttgttttttcttcacatcatgtgtcacattaagttgcatttcttctgactcaaaagaaccgatgtttgcttttaaggtttcgtattagaatcacttaactgtgcaagtggtcgatttgaccctatcaagcttgatatcgaattcctgcagcccgggctcctgcaggtaccttaattaaaagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttccccagatc

SEQ ID NO: 813 - DNA, 12509 bp, Artificial Sequence
  Description of Artificial Sequence: Synthetic DNA construct
cgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagcgctggcagtccataattgtggtccaatttgcagccgtccgagacaggaggacatcgtccagctgaaaccggggcagaatccggccatttctgaagagaaaaatggtaaactgatagaataaaatcataagaaaggagccgcacatgaaaaaagcagtcattaacggggaacaaatcagaagtatcagcgacctccaccagacattgaaaaaggagcttgcccttccggaatactacggtgaaaacctggacgctttatgggattgtctgaccggatgggtggagtacccgctcgttttggaatggaggcagtttgaacaaagcaagcagctgactgaaaatggcgccgagagtgtgcttcaggttttccgtgaagcgaaagcggaaggctgcgacatcaccatcatactttcttaatacgatcaatgggagatgaacaatatggaaacacaaaccacaattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatgtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgatagacaactgtcacggttaagcgagaaatgaataagaaggctgataattcggatctctgcgagggagatgatatttgatccggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatatcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttcatcagtgaggctgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacaccgcggtctagaactagtggatcccccctacgtgcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatccctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctggagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatctgttaatcagaaaaactcagattaatcgacaaattcgatcgcacaaactagaaactaacaccagatctagatagaaatcacaaatcgaagagtaattattcgacaaaactcaaattatttgaacaaatcggatgatatttatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaaggatatcctgatccgttgacggcgcgccttcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcaaagtgcaattgaccgatcagagtttgaagaaaaatttattacacactttatgtaaagctgaaaaaaacggcctcccgcagggaagccgtttttttcgttatctgatttttgtaaaggtctgataatggtccgttgttttgtaaatcagccagtcgcttgagtaaagaatccggtctgaatttctgaagcctgatgtatagttaatatccgctccacgccatgttcgtccgcttttgcccgggagtttgccttccctgtttgagaagatgtctccgccgatgcttttccccggagcgacgtctgcaaggttcccttttgatgccacccagccgagggcttgtgcttctgattttgtaatgtaattatcaggtagcttatgatatgtctgaagataatccgcaaccccgtcaaacgtgttgataacctgtgccatgatttgtacacaaaatttccgcgcacagatcctcacagcgtatgcaaaacaaagctgcaactactaataccagtccaaaagcaatgggcgcaacagcaacagcaaaagctgcaaccccttgtgctggttcgttcctacagttggacgcagcccgagttctgagaaacaaataaccacaaggcaagttaggtaccaaaccccttaagctcaacttaagcaaatattacaatcgtttgtttctacaaacaaatctttttcagaacggcttcaggtggggaatattgtccatttaagtacctgaaaatctaagaacacggccaatccgggcgcctttgcttgaaagtgggaagaaacctgaatgattgaacagtggataagagatttataagcaagattagcagggctgatcagattgttttttcgggtaggttgatcaatacatatgccccttccctcttcctttcctctacaatcgattgccagggagagatagagataccatcatgatgatgatggtggggatggcgatgatggtaatgatgatgatccagcagaaaaaattgcgcagaagaagaagatgagcggtcggtcggtcgatagcctttcagtcggaggggaaagaacaaaataatgcctatttgaaggcagatggattgactaagacgtgtgcaggcagtggaggagttacaaggcaggacatatttactaggtataggtgtaggtaatagtaatggagaggataaatttaggttttgggatgaatggatttgttggtacatgttgcaactcccacactgcaatcaaaggaccgctatgacaccccctgaatgcgacgcccatgagaatgccgaccccacatatacatttctggaaataatagggaaatgcacccttgcattatatttcatttattcgtcctccattttgtgcgctctccattcattttcaaatgcgctccactcttcctttatttcttaccaccattatctcgtattcgaggtccagaaatcaagttgtgaatctgccttggttgcgcattgttaaagtactcttctgtgtatatttctgccccaccgttttcacttccaacacttaaatttttttattttttattttatatatttcttataaattgttggcttctcacacgaacccaagccatccaagccccgacaaaggcaatccaatgtacttgactagagtcaaataccttttacttctttacttctcatattacccagaagccaagccaaccttaccaaactaatgtacctgagcagagtccactacctttcctcaagtacagtggcagtcagagtatatcaccgcttgttatgtatatgctttaatgctatgcttatttctaggtcataatctaaatcatatttgctgtcgagtttaagcttatcgataccgtcgacctcgagcttcttcttgaatgctcttatgggtaggattatttttcacttttttccttcatattccacacacatatatatataaacacactaacattagtgggaatatttgtttgatatgtttattttatttacttcgggggtttttgtaacaattttgtagatctaatttcttgttcttcatgtgtatattaattttcccttaagacttaaataaaaagagagagtttgttatatatagatatatgaagtgagggaaatggtacaaagttaaaggagatctgagtgagagttagataataaatgaaaagaaataagaaaccatcagggttttttctaatgtggagttttagattcagttttgtagaactaagattcactttgttgggtgttctttcttcactcatttctgttattataataataataaaatcttatatctttctattttccttactaacaagtacttgaagatttagatatatttatagatctggtgttgtaataggtaaaaacttgatttttatgactataaaagtaagttttgggaaacaaattggggagagagtaaggaaggactatgaggtcatatcttctgttttgtgatcatccatcctccattgttgttaatgtctgtgtctctctttttcttctcttctttctcttactttcctttcttatctctagctctctttctctctcatgaattatatcatatcatatatttgatacaaacacatgtgatggtaagtgagagtgaataaggtgaaactagctagatttttgagttttcatgaaattttaacttatatgagtgatagaaaataatggaacttatacgtacatgtaggacaatttagatggttatctaagtttttgtttttgttttctcttgagaatgttaaatgttagtgttatttttgtagttttggaaaattatatatgagctaagattagtttagaagtggtcaaaagaaacatagatttgaaatttcaactgaattttcaagatttcaaatagtcaatgaaacaaggaggtaattaagacaaattagcttatggggactcttttttgttattccttaaaattactctttttaaaattaaaaataactaatctcatttcgaactacattactcaaactagtaatctctaattcgacacgcaatttccaaatacttattagtagagagtcccacgtgattactttcttctccaccaaaacataaaacatgtcaagattaaatggtgtttgaaaattaaaagatcaattttcttaatcgtttacagttgtcaactctcatgtcctgaaatatataattctcatgtccaaaacaagaaaagctaacaacgacttcaaattaaatcagtcaatcaaaattagtcttcatttacctactaatttctttttatatatccgatgggtactctacgaaatcagagtttcgtttctttatttattttcttttataagatttttgaggttttttcagaggttggaattgagcgcaagattaggttttgggtctgtaagatttgttgtctttgttaaagaatctttgatcacgtcatcactcagatattatttctttttatttttcatttgtatttttactaatttattataaagttttgttagtttcagttcttgacttctgacaagaaggttttatgtcataatgaattaatttgtaacctatttataaattcaaaaatgtcatcatattactacttttgaccatttaatattagatttctcatttggtcaatacccaatgttcatattacatatatagagacaaaaattataaggatactaaattgttcatatttcttggaagtaaaaagattaatgatcactgaataaatagatttggcatagaagtatagcattggaattgcttcaacatctttggtgtagatagatttatgcaatttctctttctttttgaagtatctttttttttctagagagagaataatgttagggatttttatcattttctctctcattatgggtactgagaggaaagtgagatttttagtacggatccaatagtttaagagtttggtctgccttctacgatccaaaaaaatctacggtcatgatctctccatcgagaaggttgagagttcagacatcaaagtctataatatgtcattgtaatacgtatttgtgcatatatatctatgtacaagtacatatacaggaaactcaagaaaaaagaataaatggtaaatttaattatattccaaataaggaaagtatggaacgttgtgatgttactcggacaagtcatttagttacatccatcacgtttaaatttaatccaatggttacaattttaatactatcaaatgtctattggatttatacccaatgtgttaatgggttgttgacacatgtcacatgtctgaaaccctagacatgttcagaccaatcatgtcactctaattttgccagcatggcagttggcagccaatcactagctcgataaatttaaggtttcagaggaattttaatttatttagggttcatattgtttcataaaatgattctttatttgttacaactttaaggaaatattttattaactatttaattgttcccttttcttatattacttttgttttttcttcacatcatgtgtcacattaagttgcatttcttctgactcaaaagaaccgatgtttgcttttaaggtttcgtattagaatcacttaactgtgcaagtggtcgatttgaccctatcaagcttgatatcgaattgcggccgcatttgggctcctgcaggtaccttaattaaaagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttccccagatc

SEQ ID NO: 814 - DNA, 785 bp, Eucalyptus grandis
ctcgagttggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcattttatatagtattattttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgctcgag

SEQ ID NO: 815 - DNA, 35 bp, Artificial Sequence
  Description of Artificial Sequence: Synthetic Primer
ctcgagttggtaaggaaataattattttctttttt

SEQ ID NO: 816 - DNA, 34 bp, Artificial Sequence
  Description of Artificial Sequence: Synthetic Primer
ctcgagcaactgtaatcaatccaaatgtaagatc

SEQ ID NO: 817 - DNA, 601 bp, Eucalyptus grandis
gaagcttggcgcatcgctcgccatggcggagcacatcccgtggcttcgctggatgttcccgctggaggaggaagcgttcgccaagcacagcgcgaggagggaccgcctcacccgggccatcatggaggagcacacggtagcccgccagaagagcggggccaagcagcatttcgtcgacgccctgctcaccctcaaggacaaatacgacctcagcgaagataccatcataggactcctctgggacatgatcacagcaggcatggacactactgctatttcagtggagtgggcgatggcggagctgatcaagaacccgagggtgcaacagaaggcccaagaggagctcgaccgggtcgtcgggttcgagcgtgtggtgactgagtccgacttctcgaacctcccttacctccagtgcattgctaaggaagcgctccggctgcaccctccgaccccgctgatgctcccccaccggtccaactcccacgtcaagatcggcggctacgacatccccaaggggtcgaacgtccacgtgaatgtatgggccatcgcccgcgacccggccgtctggaatagcccgctcgagttcaggcccgagcggttc

SEQ ID NO: 818 - DNA, 16 bp, Artificial Sequence
  Description of Artificial Sequence: Synthetic oligonucleotide
aatgcggccgcagaga

SEQ ID NO: 819 - DNA, 13 bp, Artificial Sequence
  Description of Artificial Sequence: Synthetic Oligonucleotide
tctctgcggccgc

What is claimed is:

1. An isolated polynucleotide comprising a nucleic acid sequence encoding SEQ ID NO: 442 or a conservative variant of SEQ ID NO: 442, wherein the conservative variant has a sequence identity that is greater than or equal to 95% to SEQ ID NO: 442, and has the same functional properties of the polypeptide of SEQ ID NO: 442.

2. A DNA construct comprising at least one polynucleotide according to claim 1.

3. The DNA construct of claim 2, further comprising a promoter, wherein the promoter and polynucleotide are operably linked.

4. The DNA construct of claim 3, wherein the DNA construct further comprises an intron, wherein the polynucleotide, the promoter and the intron are operably linked.

5. The DNA construct of claim 2, wherein the polynucleotide encodes an RNA transcript.

6. The DNA construct of claim 3, wherein the polynucleotide is in a sense or antisense orientation relative to the promoter.

7. The DNA construct of claim 5, wherein the RNA transcript induces RNA interference.

8. A plant cell transformed with the DNA construct of claim 2.

9. A transgenic plant comprising the plant cell of claim 8.

10. The transgenic plant of claim 9, wherein a phenotype of the plant is different from a phenotype of a plant of the same species that has not been transformed with the DNA construct.

11. The transgenic plant of claim 10, wherein a phenotype that is different in the transgenic plant is the production and incorporation of syringyl monomer in lignin, and wherein the wild-type plant is characterized by lignin with little to no syringyl monomers.

12. The transgenic plant of claim 9, wherein the plant is a woody plant.

13. The transgenic plant of claim 12, wherein the plant is a tree.

14. Wood obtained from a transgenic tree which has been transformed with the DNA construct of claim 2, wherein the wood comprises said DNA construct.

15. The isolated polynucleotide of claim 1 comprising a nucleic acid encoding SEQ ID NO: 442.

16. The isolated polynucleotide of claim 1 comprising the nucleotide sequence set forth in SEQ ID NO: 190 or SEQ ID NO: 191.

* * * * *